US008461421B2

(12) United States Patent
Sampson et al.

(10) Patent No.: US 8,461,421 B2
(45) Date of Patent: Jun. 11, 2013

(54) TOXIN GENES AND METHODS FOR THEIR USE

(75) Inventors: Kimberly S. Sampson, Durham, NC (US); Daniel John Tomso, Bahama, NC (US); Shruti Agarwal, Durham, NC (US); Brian McNulty, Raleigh, NC (US); Chris Campbell, Cary, NC (US)

(73) Assignee: Athenix Corp., Morrisville, NC (US)

( * ) Notice: Subject to any disclaimer, the term of this patent is extended or adjusted under 35 U.S.C. 154(b) by 724 days.

(21) Appl. No.: 12/491,396

(22) Filed: Jun. 25, 2009

(65) Prior Publication Data

US 2010/0005543 A1      Jan. 7, 2010

Related U.S. Application Data

(60) Provisional application No. 61/158,137, filed on Mar. 6, 2009, provisional application No. 61/075,719, filed on Jun. 25, 2008.

(51) Int. Cl.
| | |
|---|---|
| *A01H 5/00* | (2006.01) |
| *C12N 15/31* | (2006.01) |
| *C12N 15/82* | (2006.01) |
| *A01N 37/18* | (2006.01) |
| *C07K 14/325* | (2006.01) |
| *C12P 21/02* | (2006.01) |
| *C12N 1/21* | (2006.01) |

(52) U.S. Cl.
USPC ...... 800/302; 514/4.5; 536/23.71; 435/320.1; 435/252.3; 435/418; 435/70.1; 800/279

(58) Field of Classification Search
None
See application file for complete search history.

(56) References Cited

U.S. PATENT DOCUMENTS

| | | | |
|---|---|---|---|
| 7,351,881 B2 | 4/2008 | Carozzi et al. | |
| 7,541,517 B2 * | 6/2009 | Flannagan et al. | ............ 800/302 |
| 2004/0250311 A1 | 12/2004 | Carozzi et al. | |
| 2008/0070829 A1 | 3/2008 | Carozzi et al. | |

FOREIGN PATENT DOCUMENTS

WO      WO 2004/074462      9/2004

OTHER PUBLICATIONS

Wasano et al (2001, Curr. Microbiol. 42:129-133).*
Bacillus Genetic Stock Center, 1989,isolate 4AP1.*
Aronson et al, 2001, FEMS Microbiol. Lett. 195:1-8.*
de Maagd et al, 2001, Trends Genet. 17:193-199.*
(de Maagd et al, 1999, Appl. Environ. Microbiol. 65:4369-4374.*
Tounsi et al, 2003, J. Appl. Microbiol. 95:23-28.*
Angsuthanasombat et al, 2001, J. Biochem. Mol. Biol. 34:402-407.*
NCBI Database Report for Accession No. AAA22330, *DNA*, 1986, pp. 305-314, vol. 5 No. 4.
NCBI Database Report for Accession No. AAA21117, Direct Submission on Dec. 15, 1993.
NCBI Database Report for Accession No. CAA85764.1, Direct Submission on Sep. 16, 1994.
NCBI Database Report for Accession No. CAD43578.1, Nov. 22, 2001, WO 0187940-A.
NCBI Database Report for Accession No. BAB72016.1, Direct Submission on Nov. 14, 2001.
NCBI Database Report for Accession No. BAD22577.1, Direct Submission on Jun. 3, 2004.
International Search Report and Written Opinion for PCT/US2009/048614 mailed Mar. 10, 2010.
EMBL Database Report for Accession No. CQ868311, Submitted on Sep. 14, 2004.
EMBL Database Report for Accession No. CQ868316, Submitted on Sep. 13, 2004.
EMBL Database Report for Accession No. EA491973, Submitted on Apr. 1, 2008.
EMBL Database Report for Accession No. EA491976, Submitted on Apr. 1, 2008.
"Plants" National Library of Medicine—Medical Subject Headings, Jan. 1, 1999. Retrieved from the internet http://www.nlm.nih.gov/cgi/mesh/2009/MB_cgi?mode=&index=10501 (retrieved on Nov. 10, 2009).
Ohba, M., and K. Aizawa. 1989. New flagellar (H) antigenic subfactors in *Bacillus thuringiensis* H serotype 3 with description of two new subspecies, *Bacillus thuringiensis* subsp. sumiyoshiensis (H serotype 3a:3d) and *Bacillus thuringiensis* subsp. fukuokaensis (H serotype 3a:3d:3e). J. Invertebr. Pathol. 54:208-212.
Yu, Y. M., M. Ohba, and S. S. Gill. 1991. Characterization of mosquitocidal activity of *Bacillus thuringiensis* subsp. fukuokaensis crystal proteins. Appl. Environ. Microbiol. 57:1075-1081.
Lee, H. K., and S. S. Gill. 1997. Molecular cloning and characterization of a novel mosquitocidal protein gene from *Bacillus thuringiensis* subsp. fukuokaensis. Appl. Environ. Microbiol. 63:4664-4670.

* cited by examiner

*Primary Examiner* — Anne Kubelik

(57) ABSTRACT

Compositions and methods for conferring pesticidal activity to bacteria, plants, plant cells, tissues and seeds are provided. Compositions comprising a coding sequence for a delta-endotoxin polypeptide are provided. The coding sequences can be used in DNA constructs or expression cassettes for transformation and expression in plants and bacteria. Compositions also comprise transformed bacteria, plants, plant cells, tissues, and seeds. In particular, isolated delta-endotoxin nucleic acid molecules are provided. Additionally, amino acid sequences corresponding to the polynucleotides are encompassed, and antibodies specifically binding to those amino acid sequences. In particular, the present invention provides for isolated nucleic acid molecules comprising nucleotide sequences encoding the amino acid sequence shown in SEQ ID NO:61-121 and 133-141, or the nucleotide sequence set forth in SEQ ID NO:1-60, 124-132, and 142-283, as well as variants and fragments thereof.

26 Claims, No Drawings

TOXIN GENES AND METHODS FOR THEIR USE

CROSS REFERENCE TO RELATED APPLICATION

This application claims the benefit of U.S. Provisional Application Ser. No. 61/075,719, filed Jun. 25, 2008, and U.S. Provisional Application Ser. No. 61/158,137, filed Mar. 6, 2009, the contents of which are herein incorporated by reference in its entirety.

REFERENCE TO SEQUENCE LISTING SUBMITTED ELECTRONICALLY

The official copy of the sequence listing is submitted electronically via EFS-Web as an ASCII formatted sequence listing with a file named "373705_SequenceListing.txt", created on Jun. 23, 2009, and having a size of 1,075 kilobytes and is filed concurrently with the specification. The sequence listing contained in this ASCII formatted document is part of the specification and is herein incorporated by reference in its entirety.

FIELD OF THE INVENTION

This invention relates to the field of molecular biology. Provided are novel genes that encode pesticidal proteins. These proteins and the nucleic acid sequences that encode them are useful in preparing pesticidal formulations and in the production of transgenic pest-resistant plants.

BACKGROUND OF THE INVENTION

*Bacillus thuringiensis* is a Gram-positive spore forming soil bacterium characterized by its ability to produce crystalline inclusions that are specifically toxic to certain orders and species of insects, but are harmless to plants and other non-targeted organisms. For this reason, compositions including *Bacillus thuringiensis* strains or their insecticidal proteins can be used as environmentally-acceptable insecticides to control agricultural insect pests or insect vectors for a variety of human or animal diseases.

Crystal (Cry) proteins (delta-endotoxins) from *Bacillus thuringiensis* have potent insecticidal activity against predominantly Lepidopteran, Dipteran, and Coleopteran larvae. These proteins also have shown activity against Hymenoptera, Homoptera, Phthiraptera, Mallophaga, and Acari pest orders, as well as other invertebrate orders such as Nemathelminthes, Platyhelminthes, and Sarcomastigorphora (Feitelson (1993) The *Bacillus Thuringiensis* family tree. In *Advanced Engineered Pesticides*, Marcel Dekker, Inc., New York, N.Y.) These proteins were originally classified as CryI to CryV based primarily on their insecticidal activity. The major classes were Lepidoptera-specific (I), Lepidoptera- and Diptera-specific (II), Coleoptera-specific (III), Diptera-specific (IV), and nematode-specific (V) and (VI). The proteins were further classified into subfamilies; more highly related proteins within each family were assigned divisional letters such as Cry1A, Cry1B, Cry1C, etc. Even more closely related proteins within each division were given names such as Cry1C1, Cry1C2, etc.

A new nomenclature was recently described for the Cry genes based upon amino acid sequence homology rather than insect target specificity (Crickmore et al. (1998) *Microbiol. Mol. Biol. Rev.* 62:807-813). In the new classification, each toxin is assigned a unique name incorporating a primary rank (an Arabic number), a secondary rank (an uppercase letter), a tertiary rank (a lowercase letter), and a quaternary rank (another Arabic number). In the new classification, Roman numerals have been exchanged for Arabic numerals in the primary rank. Proteins with less than 45% sequence identity have different primary ranks, and the criteria for secondary and tertiary ranks are 78% and 95%, respectively.

The crystal protein does not exhibit insecticidal activity until it has been ingested and solubilized in the insect midgut. The ingested protoxin is hydrolyzed by proteases in the insect digestive tract to an active toxic molecule. (Höfte and Whiteley (1989) *Microbiol. Rev.* 53:242-255). This toxin binds to apical brush border receptors in the midgut of the target larvae and inserts into the apical membrane creating ion channels or pores, resulting in larval death.

Delta-endotoxins generally have five conserved sequence domains, and three conserved structural domains (see, for example, de Maagd et al. (2001) *Trends Genetics* 17:193-199). The first conserved structural domain consists of seven alpha helices and is involved in membrane insertion and pore formation. Domain II consists of three beta-sheets arranged in a Greek key configuration, and domain III consists of two antiparallel beta-sheets in "jelly-roll" formation (de Maagd et al., 2001, supra). Domains II and III are involved in receptor recognition and binding, and are therefore considered determinants of toxin specificity.

The intensive use of *B. thuringiensis*-based insecticides has already given rise to resistance in field populations of the diamondback moth, *Plutella xylostella* (Ferré and Van Rie (2002) *Annu. Rev. Entomol.* 47:501-533). The most common mechanism of resistance is the reduction of binding of the toxin to its specific midgut receptor(s). This may also confer cross-resistance to other toxins that share the same receptor (Ferré and Van Rie (2002)).

SUMMARY OF INVENTION

Compositions and methods for conferring pest resistance to bacteria, plants, plant cells, tissues and seeds are provided. Compositions include nucleic acid molecules encoding sequences for delta-endotoxin polypeptides, vectors comprising those nucleic acid molecules, and host cells comprising the vectors. Compositions also include the polypeptide sequences of the endotoxin, and antibodies to those polypeptides. The nucleotide sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues, and seeds.

In particular, isolated nucleic acid molecules corresponding to delta-endotoxin nucleic acid sequences are provided. Additionally, amino acid sequences corresponding to the polynucleotides are encompassed. In particular, the present invention provides for an isolated nucleic acid molecule comprising a nucleotide sequence encoding the amino acid sequence shown in any of SEQ ID NO:61-121 and 133-141, or a nucleotide sequence set forth in any of SEQ ID NO:1-60 and 124-132, as well as variants and fragments thereof. Nucleotide sequences that are complementary to a nucleotide sequence of the invention, or that hybridize to a sequence of the invention are also encompassed.

The compositions and methods of the invention are useful for the production of organisms with pesticide resistance, specifically bacteria and plants. These organisms and compositions derived from them are desirable for agricultural purposes. The compositions of the invention are also useful for generating altered or improved delta-endotoxin proteins that have pesticidal activity, or for detecting the presence of delta-endotoxin proteins or nucleic acids in products or organisms.

DETAILED DESCRIPTION

The present invention is drawn to compositions and methods for regulating pest resistance in organisms, particularly plants or plant cells. The methods involve transforming organisms with a nucleotide sequence encoding a delta-endotoxin protein of the invention. In particular, the nucleotide sequences of the invention are useful for preparing plants and microorganisms that possess pesticidal activity. Thus, transformed bacteria, plants, plant cells, plant tissues and seeds are provided. Compositions are delta-endotoxin nucleic acids and proteins of *Bacillus thuringiensis*. The sequences find use in the construction of expression vectors for subsequent transformation into organisms of interest, as probes for the isolation of other delta-endotoxin genes, and for the generation of altered pesticidal proteins by methods known in the art, such as domain swapping or DNA shuffling. The proteins find use in controlling or killing lepidopteran, coleopteran, and nematode pest populations, and for producing compositions with pesticidal activity.

By "delta-endotoxin" is intended a toxin from *Bacillus thuringiensis* that has toxic activity against one or more pests, including, but not limited to, members of the Lepidoptera, Diptera, and Coleoptera orders or members of the Nematoda phylum, or a protein that has homology to such a protein. In some cases, delta-endotoxin proteins have been isolated from other organisms, including *Clostridium bifermentans* and *Paenibacillus popilliae*. Delta-endotoxin proteins include amino acid sequences deduced from the full-length nucleotide sequences disclosed herein, and amino acid sequences that are shorter than the full-length sequences, either due to the use of an alternate downstream start site, or due to processing that produces a shorter protein having pesticidal activity. Processing may occur in the organism the protein is expressed in, or in the pest after ingestion of the protein.

Delta-endotoxins include proteins identified as cry1 through cry43, cyt1 and cyt2, and Cyt-like toxin. There are currently over 250 known species of delta-endotoxins with a wide range of specificities and toxicities. For an expansive list see Crickmore et al. (1998), *Microbiol. Mol. Biol. Rev.* 62:807-813, and for regular updates see Crickmore et al. (2003) "*Bacillus thuringiensis* toxin nomenclature," at www.biols.susx.ac.uk/Home/Neil_Crickmore/Bt/index.

Provided herein are novel isolated nucleotide sequences that confer pesticidal activity. Also provided are the amino acid sequences of the delta-endotoxin proteins. The protein resulting from translation of this gene allows cells to control or kill pests that ingest it.

Isolated Nucleic Acid Molecules, and Variants and Fragments Thereof

One aspect of the invention pertains to isolated or recombinant nucleic acid molecules comprising nucleotide sequences encoding delta-endotoxin proteins and polypeptides or biologically active portions thereof, as well as nucleic acid molecules sufficient for use as hybridization probes to identify delta-endotoxin encoding nucleic acids. As used herein, the term "nucleic acid molecule" is intended to include DNA molecules (e.g., recombinant DNA, cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. Preferably, an "isolated" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the invention, "isolated" when used to refer to nucleic acid molecules excludes isolated chromosomes. For example, in various embodiments, the isolated delta-endotoxin encoding nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A delta-endotoxin protein that is substantially free of cellular material includes preparations of protein having less than about 30%, 20%, 10%, or 5% (by dry weight) of non-delta-endotoxin protein (also referred to herein as a "contaminating protein").

Nucleotide sequences encoding the proteins of the present invention include the sequence set forth in SEQ ID NO:1-60 and 124-132, and variants, fragments, and complements thereof. By "complement" is intended a nucleotide sequence that is sufficiently complementary to a given nucleotide sequence such that it can hybridize to the given nucleotide sequence to thereby form a stable duplex. The corresponding amino acid sequence for the delta-endotoxin protein encoded by this nucleotide sequence are set forth in SEQ ID NO:61-121 and 133-141.

Nucleic acid molecules that are fragments of these delta-endotoxin encoding nucleotide sequences are also encompassed by the present invention. By "fragment" is intended a portion of the nucleotide sequence encoding a delta-endotoxin protein. A fragment of a nucleotide sequence may encode a biologically active portion of a delta-endotoxin protein, or it may be a fragment that can be used as a hybridization probe or PCR primer using methods disclosed below. Nucleic acid molecules that are fragments of a delta-endotoxin nucleotide sequence comprise at least about 50, 100, 200, 300, 400, 500, 600, 700, 800, 900, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2150, 2200, 2250, 2300, 2350, 2400, 2450, 2500, 2550, 2600, 2650, 2700, 2750, 2800, 2850, 2900, 2950, 3000, 3050, 3100, 3150, 3200, 3250, 3300, 3350 contiguous nucleotides, or up to the number of nucleotides present in a full-length delta-endotoxin encoding nucleotide sequence disclosed herein depending upon the intended use. By "contiguous" nucleotides is intended nucleotide residues that are immediately adjacent to one another. Fragments of the nucleotide sequences of the present invention will encode protein fragments that retain the biological activity of the delta-endotoxin protein and, hence, retain pesticidal activity. By "retains activity" is intended that the fragment will have at least about 30%, at least about 50%, at least about 70%, 80%, 90%, 95% or higher of the pesticidal activity of the delta-endotoxin protein. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

A fragment of a delta-endotoxin encoding nucleotide sequence that encodes a biologically active portion of a protein of the invention will encode at least about 15, 25, 30, 50, 75, 100, 125, 150, 175, 200, 250, 300, 350, 400, 450, 500, 550, 600, 650, 700, 750, 800, 850, 900, 950, 1000, 1050, 1100 contiguous amino acids, or up to the total number of amino acids present in a full-length delta-endotoxin protein of the invention.

Preferred delta-endotoxin proteins of the present invention are encoded by a nucleotide sequence sufficiently identical to the nucleotide sequence of SEQ ID NO:1-60 and 124-132. By "sufficiently identical" is intended an amino acid or nucleotide sequence that has at least about 60% or 65% sequence identity, about 70% or 75% sequence identity, about 80% or 85% sequence identity, about 90%, 91%, 92%, 93%, 94%, 95%, 96%, 97%, 98%, 99% or greater sequence identity compared to a reference sequence using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

To determine the percent identity of two amino acid sequences or of two nucleic acids, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of one of SEQ ID NO:1-60 and 124-132, or across the entirety of one of SEQ ID NO:61-121 and 133-141). The percent identity between two sequences can be determined using techniques similar to those described below, with or without allowing gaps. In calculating percent identity, typically exact matches are counted.

The determination of percent identity between two sequences can be accomplished using a mathematical algorithm. A nonlimiting example of a mathematical algorithm utilized for the comparison of two sequences is the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877. Such an algorithm is incorporated into the BLASTN and BLASTX programs of Altschul et al. (1990) *J. Mol. Biol.* 215:403. BLAST nucleotide searches can be performed with the BLASTN program, score=100, wordlength=12, to obtain nucleotide sequences homologous to delta-endotoxin-like nucleic acid molecules of the invention. BLAST protein searches can be performed with the BLASTX program, score=50, wordlength=3, to obtain amino acid sequences homologous to delta-endotoxin protein molecules of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins et al. (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX module of the Vector NTI Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™. GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller (1988) *CABIOS* 4: 11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Unless otherwise stated, GAP Version 10, which uses the algorithm of Needleman and Wunsch (1970) *J. Mol. Biol.* 48(3):443-453, will be used to determine sequence identity or similarity using the following parameters: % identity and % similarity for a nucleotide sequence using GAP Weight of 50 and Length Weight of 3, and the nwsgapdna.cmp scoring matrix; % identity or % similarity for an amino acid sequence using GAP weight of 8 and length weight of 2, and the BLOSUM62 scoring program. Equivalent programs may also be used. By "equivalent program" is intended any sequence comparison program that, for any two sequences in question, generates an alignment having identical nucleotide residue matches and an identical percent sequence identity when compared to the corresponding alignment generated by GAP Version 10.

The invention also encompasses variant nucleic acid molecules. "Variants" of the delta-endotoxin encoding nucleotide sequences include those sequences that encode the delta-endotoxin proteins disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleotide sequences also include synthetically derived nucleotide sequences that have been generated, for example, by using site-directed mutagenesis but which still encode the delta-endotoxin proteins disclosed in the present invention as discussed below. Variant proteins encompassed by the present invention are biologically active, that is they continue to possess the desired biological activity of the native protein, that is, retaining pesticidal activity. By "retains activity" is intended that the variant will have at least about 30%, at least about 50%, at least about 70%, or at least about 80% of the pesticidal activity of the native protein. Methods for measuring pesticidal activity are well known in the art. See, for example, Czapla and Lang (1990) *J. Econ. Entomol.* 83: 2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

The skilled artisan will further appreciate that changes can be introduced by mutation of the nucleotide sequences of the invention thereby leading to changes in the amino acid sequence of the encoded delta-endotoxin proteins, without altering the biological activity of the proteins. Thus, variant isolated nucleic acid molecules can be created by introducing one or more nucleotide substitutions, additions, or deletions into the corresponding nucleotide sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleotide sequences are also encompassed by the present invention.

For example, conservative amino acid substitutions may be made at one or more predicted, nonessential amino acid residues. A "nonessential" amino acid residue is a residue that can be altered from the wild-type sequence of a delta-endotoxin protein without altering the biological activity, whereas an "essential" amino acid residue is required for biological activity. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Delta-endotoxins generally have five conserved sequence domains, and three conserved structural domains (see, for example, de Maagd et al. (2001) *Trends Genetics* 17:193-199). The first conserved structural domain consists of seven alpha helices and is involved in membrane insertion and pore formation. Domain II consists of three beta-sheets arranged in a Greek key configuration, and domain III consists of two antiparallel beta-sheets in "jelly-roll" formation (de Maagd et al., 2001, supra). Domains II and III are involved in receptor recognition and binding, and are therefore considered determinants of toxin specificity.

Amino acid substitutions may be made in nonconserved regions that retain function. In general, such substitutions would not be made for conserved amino acid residues, or for amino acid residues residing within a conserved motif, where such residues are essential for protein activity. Examples of residues that are conserved and that may be essential for protein activity include, for example, residues that are identical between all proteins contained in an alignment of the amino acid sequences of the present invention and known delta-endotoxin sequences. Examples of residues that are conserved but that may allow conservative amino acid substitutions and still retain activity include, for example, residues that have only conservative substitutions between all proteins contained in an alignment of the amino acid sequences of the present invention and known delta-endotoxin sequences. However, one of skill in the art would understand that functional variants may have minor conserved or nonconserved alterations in the conserved residues.

Alternatively, variant nucleotide sequences can be made by introducing mutations randomly along all or part of the coding sequence, such as by saturation mutagenesis, and the resultant mutants can be screened for ability to confer delta-endotoxin activity to identify mutants that retain activity. Following mutagenesis, the encoded protein can be expressed recombinantly, and the activity of the protein can be determined using standard assay techniques.

Using methods such as PCR, hybridization, and the like corresponding delta-endotoxin sequences can be identified, such sequences having substantial identity to the sequences of the invention. See, for example, Sambrook and Russell (2001) *Molecular Cloning: A Laboratory Manual*. (Cold Spring Harbor Laboratory Press, Cold Spring Harbor, N.Y.) and Innis, et al. (1990) *PCR Protocols: A Guide to Methods and Applications* (Academic Press, NY).

In a hybridization method, all or part of the delta-endotoxin nucleotide sequence can be used to screen cDNA or genomic libraries. Methods for construction of such cDNA and genomic libraries are generally known in the art and are disclosed in Sambrook and Russell, 2001, supra. The so-called hybridization probes may be genomic DNA fragments, cDNA fragments, RNA fragments, or other oligonucleotides, and may be labeled with a detectable group such as $^{32}P$, or any other detectable marker, such as other radioisotopes, a fluorescent compound, an enzyme, or an enzyme co-factor. Probes for hybridization can be made by labeling synthetic oligonucleotides based on the known delta-endotoxin-encoding nucleotide sequence disclosed herein. Degenerate primers designed on the basis of conserved nucleotides or amino acid residues in the nucleotide sequence or encoded amino acid sequence can additionally be used. The probe typically comprises a region of nucleotide sequence that hybridizes under stringent conditions to at least about 12, at least about 25, at least about 50, 75, 100, 125, 150, 175, 200, 250, 300, 350, or 400 consecutive nucleotides of delta-endotoxin encoding nucleotide sequence of the invention or a fragment or variant thereof. Methods for the preparation of probes for hybridization are generally known in the art and are disclosed in Sambrook and Russell, 2001, supra herein incorporated by reference.

For example, an entire delta-endotoxin sequence disclosed herein, or one or more portions thereof, may be used as a probe capable of specifically hybridizing to corresponding delta-endotoxin-like sequences and messenger RNAs. To achieve specific hybridization under a variety of conditions, such probes include sequences that are unique and are preferably at least about 10 nucleotides in length, or at least about 20 nucleotides in length. Such probes may be used to amplify corresponding delta-endotoxin sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Cold Spring Harbor, N.Y.).

Hybridization of such sequences may be carried out under stringent conditions. By "stringent conditions" or "stringent hybridization conditions" is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1× SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138:267-284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is preferred to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al, eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Cold Spring Harbor, N.Y.).

Isolated Proteins and Variants and Fragments Thereof

Delta-endotoxin proteins are also encompassed within the present invention. By "delta-endotoxin protein" is intended a protein having the amino acid sequence set forth in SEQ ID NO:61-121 and 133-141. Fragments, biologically active portions, and variants thereof are also provided, and may be used to practice the methods of the present invention.

"Fragments" or "biologically active portions" include polypeptide fragments comprising amino acid sequences sufficiently identical to the amino acid sequence set forth in any of SEQ ID NO:61-121 and 133-141 and that exhibit pesticidal activity. A biologically active portion of a delta-endotoxin protein can be a polypeptide that is, for example, 10, 25, 50, 100 or more amino acids in length. Such biologically active portions can be prepared by recombinant techniques and evaluated for pesticidal activity. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety. As used here, a fragment comprises at least 8 contiguous amino acids of SEQ ID NO:61-121 and 133-141. The invention encompasses other fragments, however, such as any fragment in the protein greater than about 10, 20, 30, 50, 100, 150, 200, 250, 300, 350, 400, 400, 450, 500, 550, 600, 650, 700, 750, 800, 850, 900, 950, 1000, 1050, 1100, 1150, 1200, 1250, or 1300 amino acids.

By "variants" is intended proteins or polypeptides having an amino acid sequence that is at least about 60%, 65%, about 70%, 75%, about 80%, 85%, about 90%, 91%, 92%, 93%, 94%, 95%, 96%, 97%, 98% or 99% identical to the amino acid sequence of any of SEQ ID NO:61-121 and 133-141. Variants also include polypeptides encoded by a nucleic acid molecule that hybridizes to the nucleic acid molecule of SEQ ID NO:1-60 and 124-132, or a complement thereof, under stringent conditions. Variants include polypeptides that differ in amino acid sequence due to mutagenesis. Variant proteins encompassed by the present invention are biologically active, that is they continue to possess the desired biological activity of the native protein, that is, retaining pesticidal activity. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

Bacterial genes, such as the axmi genes of this invention, quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. Furthermore, it is not often determined a priori which of these codons are used naturally in the bacterium. Thus, it is understood that use of one of the alternate methionine codons may also lead to generation of delta-endotoxin proteins that encode pesticidal activity. These delta-endotoxin proteins are encompassed in the present invention and may be used in the methods of the present invention.

Antibodies to the polypeptides of the present invention, or to variants or fragments thereof, are also encompassed. Methods for producing antibodies are well known in the art (see, for example, Harlow and Lane (1988) *Antibodies: A Laboratory Manual*, Cold Spring Harbor Laboratory, Cold Spring Harbor, N.Y.; U.S. Pat. No. 4,196,265).

Altered or Improved Variants

It is recognized that DNA sequences of a delta-endotoxin may be altered by various methods, and that these alterations may result in DNA sequences encoding proteins with amino acid sequences different than that encoded by a delta-endotoxin of the present invention. This protein may be altered in various ways including amino acid substitutions, deletions, truncations, and insertions of one or more amino acids of SEQ ID NO:61-121 and 133-141, including up to about 2, about 3, about 4, about 5, about 6, about 7, about 8, about 9, about 10, about 15, about 20, about 25, about 30, about 35, about 40, about 45, about 50, about 55, about 60, about 65, about 70, about 75, about 80, about 85, about 90, about 100, about 105, about 110, about 115, about 120, about 125, about 130 or more amino acid substitutions, deletions or insertions.

Methods for such manipulations are generally known in the art. For example, amino acid sequence variants of a delta-endotoxin protein can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a delta-endotoxin to confer pesticidal activity may be improved by the use of such techniques upon the compositions of this invention. For example, one may express a delta-endotoxin in host cells that exhibit high rates of base misincorporation during DNA replication, such as XL-1 Red (Stratagene). After propagation in such strains, one can isolate the delta-endotoxin DNA (for example by preparing plasmid DNA, or by amplifying by PCR and cloning the resulting PCR fragment into a vector), culture the delta-endotoxin mutations in a non-mutagenic strain, and identify mutated delta-endotoxin genes with pesticidal activity, for example by performing an assay to test for pesticidal activity. Generally, the protein is mixed and used in feeding assays. See, for example Marrone et al. (1985) *J. of Economic Entomology* 78:290-293. Such assays can include contacting plants with one or more pests and determining the plant's ability to survive and/or cause the death of the pests. Examples of mutations that result in increased toxicity are found in Schnepf et al. (1998) *Microbiol. Mol. Biol. Rev.* 62:775-806.

Alternatively, alterations may be made to the protein sequence of many proteins at the amino or carboxy terminus without substantially affecting activity. This can include insertions, deletions, or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity, or epitope to facilitate either protein purification, protein detection, or other experimental uses known in the art (3) target secretion or translation of a protein to a subcellular organelle, such as the periplasmic space of Gram-negative bacteria, or the endoplasmic reticulum of eukaryotic cells, the latter of which often results in glycosylation of the protein.

Variant nucleotide and amino acid sequences of the present invention also encompass sequences derived from mutagenic and recombinogenic procedures such as DNA shuffling. With such a procedure, one or more different delta-endotoxin protein coding regions can be used to create a new delta-endotoxin protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a delta-endotoxin gene of the invention and other known delta-endotoxin genes to obtain a new gene coding for a protein with an improved property of interest, such as an increased insecticidal activity. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Domain swapping or shuffling is another mechanism for generating altered delta-endotoxin proteins. Domains II and III may be swapped between delta-endotoxin proteins, resulting in hybrid or chimeric toxins with improved pesticidal activity or target spectrum. Methods for generating recombinant proteins and testing them for pesticidal activity are well known in the art (see, for example, Naimov et al. (2001) *Appl. Environ. Microbiol.* 67:5328-5330; de Maagd et al. (1996) *Appl. Environ. Microbiol.* 62:1537-1543; Ge et al. (1991) *J. Biol. Chem.* 266:17954-17958; Schnepf et al. (1990) *J. Biol. Chem.* 265:20923-20930; Rang et al. 91999) *Appl. Environ. Microbiol.* 65:2918-2925).

Vectors

A delta-endotoxin sequence of the invention may be provided in an expression cassette for expression in a plant of interest. By "plant expression cassette" is intended a DNA construct that is capable of resulting in the expression of a protein from an open reading frame in a plant cell. Typically these contain a promoter and a coding sequence. Often, such constructs will also contain a 3' untranslated region. Such constructs may contain a "signal sequence" or "leader sequence" to facilitate co-translational or post-translational transport of the peptide to certain intracellular structures such as the chloroplast (or other plastid), endoplasmic reticulum, or Golgi apparatus.

By "signal sequence" is intended a sequence that is known or suspected to result in cotranslational or post-translational peptide transport across the cell membrane. In eukaryotes, this typically involves secretion into the Golgi apparatus, with some resulting glycosylation. By "leader sequence" is intended any sequence that when translated, results in an amino acid sequence sufficient to trigger co-translational transport of the peptide chain to a sub-cellular organelle. Thus, this includes leader sequences targeting transport and/or glycosylation by passage into the endoplasmic reticulum, passage to vacuoles, plastids including chloroplasts, mitochondria, and the like.

By "plant transformation vector" is intended a DNA molecule that is necessary for efficient transformation of a plant cell. Such a molecule may consist of one or more plant expression cassettes, and may be organized into more than one "vector" DNA molecule. For example, binary vectors are plant transformation vectors that utilize two non-contiguous DNA vectors to encode all requisite cis- and trans-acting functions for transformation of plant cells (Hellens and Mullineaux (2000) *Trends in Plant Science* 5:446-451). "Vector" refers to a nucleic acid construct designed for transfer between different host cells. "Expression vector" refers to a vector that has the ability to incorporate, integrate and express heterologous DNA sequences or fragments in a foreign cell. The cassette will include 5' and 3' regulatory sequences operably linked to a sequence of the invention. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

"Promoter" refers to a nucleic acid sequence that functions to direct transcription of a downstream coding sequence. The promoter together with other transcriptional and translational regulatory nucleic acid sequences (also termed "control sequences") are necessary for the expression of a DNA sequence of interest.

Such an expression cassette is provided with a plurality of restriction sites for insertion of the delta-endotoxin sequence to be under the transcriptional regulation of the regulatory regions.

The expression cassette will include in the 5'-3' direction of transcription, a transcriptional and translational initiation region (i.e., a promoter), a DNA sequence of the invention, and a translational and transcriptional termination region (i.e., termination region) functional in plants. The promoter may be native or analogous, or foreign or heterologous, to the plant host and/or to the DNA sequence of the invention. Additionally, the promoter may be the natural sequence or alternatively a synthetic sequence. Where the promoter is "native" or "homologous" to the plant host, it is intended that the promoter is found in the native plant into which the promoter is introduced. Where the promoter is "foreign" or "heterologous" to the DNA sequence of the invention, it is intended that the promoter is not the native or naturally occurring promoter for the operably linked DNA sequence of the invention.

The termination region may be native with the transcriptional initiation region, may be native with the operably linked DNA sequence of interest, may be native with the plant host, or may be derived from another source (i.e., foreign or heterologous to the promoter, the DNA sequence of interest, the plant host, or any combination thereof). Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acid Res.* 15:9627-9639.

Where appropriate, the gene(s) may be optimized for increased expression in the transformed host cell. That is, the genes can be synthesized using host cell-preferred codons for improved expression, or may be synthesized using codons at a host-preferred codon usage frequency. Generally, the GC content of the gene will be increased. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

In one embodiment, the delta-endotoxin is targeted to the chloroplast for expression. In this manner, where the delta-endotoxin is not directly inserted into the chloroplast, the expression cassette will additionally contain a nucleic acid encoding a transit peptide to direct the delta-endotoxin to the chloroplasts. Such transit peptides are known in the art. See, for example, Von Heijne et al. (1991) *Plant Mol. Biol. Rep.* 9:104-126; Clark et al. (1989) *J. Biol. Chem.* 264:17544-17550; Della-Cioppa et al. (1987) *Plant Physiol.* 84:965-968; Romer et al. (1993) *Biochem. Biophys. Res. Commun.* 196:1414-1421; and Shah et al. (1986) *Science* 233:478-481.

The delta-endotoxin gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

Plant Transformation

Methods of the invention involve introducing a nucleotide construct into a plant. By "introducing" is intended to present to the plant the nucleotide construct in such a manner that the construct gains access to the interior of a cell of the plant. The methods of the invention do not require that a particular method for introducing a nucleotide construct to a plant is used, only that the nucleotide construct gains access to the interior of at least one cell of the plant. Methods for introducing nucleotide constructs into plants are known in the art including, but not limited to, stable transformation methods, transient transformation methods, and virus-mediated methods.

By "plant" is intended whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated exogenous nucleic acid sequences or DNA fragments into the plant cell. These nucleic acid sequences include those that are exogenous, or not present in the untransformed plant cell, as well as those that may be endogenous, or present in the untransformed plant cell. "Heterologous" generally refers to the nucleic acid sequences that are not endogenous to the cell or part of the native genome in which they are present, and have been added to the cell by infection, transfection, microinjection, electroporation, microprojection, or the like.

Transformation of plant cells can be accomplished by one of several techniques known in the art. The delta-endotoxin gene of the invention may be modified to obtain or enhance expression in plant cells. Typically a construct that expresses such a protein would contain a promoter to drive transcription of the gene, as well as a 3' untranslated region to allow transcription termination and polyadenylation. The organization of such constructs is well known in the art. In some instances, it may be useful to engineer the gene such that the resulting peptide is secreted, or otherwise targeted within the plant cell. For example, the gene can be engineered to contain a signal peptide to facilitate transfer of the peptide to the endoplasmic reticulum. It may also be preferable to engineer the plant expression cassette to contain an intron, such that mRNA processing of the intron is required for expression.

Typically this "plant expression cassette" will be inserted into a "plant transformation vector". This plant transformation vector may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the delta-endotoxin are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g. immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g. Hiei et al. (1994) *The Plant Journal* 6:271-282; Ishida et al. (1996) *Nature Biotechnology* 14:745-750). Explants are typically transferred to a fresh supply of the same medium and cultured routinely. A general description of the techniques and methods for generating transgenic plants are found in Ayres and Park (1994) *Critical Reviews in Plant Science* 13:219-239 and Bommineni and Jauhar (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

Transformation protocols as well as protocols for introducing nucleotide sequences into plants may vary depending on the type of plant or plant cell, i.e., monocot or dicot, targeted for transformation. Generation of transgenic plants may be performed by one of several methods, including, but not limited to, microinjection, electroporation, direct gene transfer, introduction of heterologous DNA by *Agrobacterium* into plant cells (*Agrobacterium*-mediated transformation), bombardment of plant cells with heterologous foreign DNA adhered to particles, ballistic particle acceleration, aerosol beam transformation (U.S. Published Application No. 20010026941; U.S. Pat. No. 4,945,050; International Publication No. WO 91/00915; U.S. Published Application No. 2002015066), Lec1 transformation, and various other non-particle direct-mediated methods to transfer DNA.

Methods for transformation of chloroplasts are known in the art. See, for example, Svab et al. (1990) *Proc. Natl. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell (2001) *Molecular Cloning: A Laboratory Manual*. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, 2001, supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled $^{32}$P target DNA fragment to confirm the integration of introduced gene into the plant genome according to standard techniques (Sambrook and Russell, 2001, supra).

In Northern blot analysis, RNA is isolated from specific tissues of transformant, fractionated in a formaldehyde agarose gel, and blotted onto a nylon filter according to standard procedures that are routinely used in the art (Sambrook and Russell, 2001, supra). Expression of RNA encoded by the delta-endotoxin is then tested by hybridizing the filter to a radioactive probe derived from a delta-endotoxin, by methods known in the art (Sambrook and Russell, 2001, supra).

Western blot, biochemical assays and the like may be carried out on the transgenic plants to confirm the presence of protein encoded by the delta-endotoxin gene by standard procedures (Sambrook and Russell, 2001, supra) using antibodies that bind to one or more epitopes present on the delta-endotoxin protein.

Pesticidal Activity in Plants

In another aspect of the invention, one may generate transgenic plants expressing a delta-endotoxin that has pesticidal activity. Methods described above by way of example may be utilized to generate transgenic plants, but the manner in which the transgenic plant cells are generated is not critical to this invention. Methods known or described in the art such as *Agrobacterium*-mediated transformation, biolistic transformation, and non-particle-mediated methods may be used at the discretion of the experimenter. Plants expressing a delta-endotoxin may be isolated by common methods described in the art, for example by transformation of callus, selection of transformed callus, and regeneration of fertile plants from such transgenic callus. In such process, one may use any gene as a selectable marker so long as its expression in plant cells confers ability to identify or select for transformed cells.

A number of markers have been developed for use with plant cells, such as resistance to chloramphenicol, the aminoglycoside G418, hygromycin, or the like. Other genes that encode a product involved in chloroplast metabolism may also be used as selectable markers. For example, genes that provide resistance to plant herbicides such as glyphosate, bromoxynil, or imidazolinone may find particular use. Such genes have been reported (Stalker et al. (1985) *J. Biol. Chem.* 263:6310-6314 (bromoxynil resistance nitrilase gene); and Sathasivan et al. (1990) *Nucl. Acids Res.* 18:2188 (AHAS imidazolinone resistance gene). Additionally, the genes disclosed herein are useful as markers to assess transformation of bacterial or plant cells. Methods for detecting the presence of a transgene in a plant, plant organ (e.g., leaves, stems, roots, etc.), seed, plant cell, propagule, embryo or progeny of the same are well known in the art. In one embodiment, the presence of the transgene is detected by testing for pesticidal activity.

Fertile plants expressing a delta-endotoxin may be tested for pesticidal activity, and the plants showing optimal activity selected for further breeding. Methods are available in the art to assay for pest activity. Generally, the protein is mixed and used in feeding assays. See, for example Marrone et al. (1985) *J. of Economic Entomology* 78:290-293.

The present invention may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers.

Vegetables include, but are not limited to, tomatoes, lettuce, green beans, lima beans, peas, and members of the genus *Curcumis* such as cucumber, cantaloupe, and musk melon. Ornamentals include, but are not limited to, azalea, hydrangea, hibiscus, roses, tulips, daffodils, petunias, carnation, poinsettia, and chrysanthemum. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape., etc.).

Use in Pest Control

General methods for employing strains comprising a nucleotide sequence of the present invention, or a variant thereof, in pesticide control or in engineering other organisms as pesticidal agents are known in the art. See, for example U.S. Pat. No. 5,039,523 and EP 0480762A2.

The *Bacillus* strains containing a nucleotide sequence of the present invention, or a variant thereof, or the microorganisms that have been genetically altered to contain a pesticidal gene and protein may be used for protecting agricultural crops and products from pests. In one aspect of the invention, whole, i.e., unlysed, cells of a toxin (pesticide)-producing organism are treated with reagents that prolong the activity of the toxin produced in the cell when the cell is applied to the environment of target pest(s).

Alternatively, the pesticide is produced by introducing a delta-endotoxin gene into a cellular host. Expression of the delta-endotoxin gene results, directly or indirectly, in the intracellular production and maintenance of the pesticide. In one aspect of this invention, these cells are then treated under conditions that prolong the activity of the toxin produced in the cell when the cell is applied to the environment of target pest(s). The resulting product retains the toxicity of the toxin. These naturally encapsulated pesticides may then be formulated in accordance with conventional techniques for application to the environment hosting a target pest, e.g., soil, water, and foliage of plants. See, for example EPA 0192319, and the references cited therein. Alternatively, one may formulate the cells expressing a gene of this invention such as to allow application of the resulting material as a pesticide.

Pesticidal Compositions

The active ingredients of the present invention are normally applied in the form of compositions and can be applied to the crop area or plant to be treated, simultaneously or in succession, with other compounds. These compounds can be fertilizers, weed killers, cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient of the present invention or an agrochemical composition of the present invention that contains at least one of the pesticidal proteins produced by the bacterial strains of the present invention include leaf application, seed coating and soil application. The number of applications and the rate of application depend on the intensity of infestation by the corresponding pest.

The composition may be formulated as a powder, dust, pellet, granule, spray, emulsion, colloid, solution, or such like, and may be prepared by such conventional means as desiccation, lyophilization, homogenation, extraction, filtration, centrifugation, sedimentation, or concentration of a culture of cells comprising the polypeptide. In all such compositions that contain at least one such pesticidal polypeptide, the polypeptide may be present in a concentration of from about 1% to about 99% by weight.

Lepidopteran, coleopteran, or nematode pests may be killed or reduced in numbers in a given area by the methods of the invention, or may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, crystal and/or spore suspension, or isolated protein component with the desired agriculturally-acceptable carrier. The compositions may be formulated prior to administration in an appropriate means such as lyophilized, freeze-dried, desiccated, or in an aqueous carrier, medium or suitable diluent, such as saline or other buffer. The formulated compositions may be in the form of a dust or granular material, or a suspension in oil (vegetable or mineral), or water or oil/water emulsions, or as a wettable powder, or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference.

"Pest" includes but is not limited to, insects, fungi, bacteria, nematodes, mites, ticks, and the like. Insect pests include insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, etc., particularly Coleoptera, Lepidoptera, and Diptera.

The order Coleoptera includes the suborders Adephaga and Polyphaga. Suborder Adephaga includes the superfamilies Caraboidea and Gyrinoidea, while suborder Polyphaga includes the superfamilies Hydrophiloidea, Staphylinoidea, Cantharoidea, Cleroidea, Elateroidea, Dascilloidea, Dryopoidea, Byrrhoidea, Cucujoidea, Meloidea, Mordelloidea, Tenebrionoidea, Bostrichoidea, Scarabaeoidea, Cerambycoidea, Chrysomeloidea, and Curculionoidea. Superfamily Caraboidea includes the families Cicindelidae, Carabidae, and Dytiscidae. Superfamily Gyrinoidea includes the family Gyrinidae. Superfamily Hydrophiloidea includes the family Hydrophilidae. Superfamily Staphylinoidea includes the families Silphidae and Staphylinidae. Superfamily Cantharoidea includes the families Cantharidae and Lampyridae. Superfamily Cleroidea includes the families Cleridae and Dermestidae. Superfamily Elateroidea includes the families Elateridae and Buprestidae. Superfamily Cucujoidea includes the family Coccinellidae. Superfamily Meloidea includes the family Meloidae. Superfamily Tenebrionoidea includes the family Tenebrionidae. Superfamily Scarabaeoidea includes the families Passalidae and Scarabaeidae. Superfamily Cerambycoidea includes the family Cerambycidae. Superfamily Chrysomeloidea includes the family Chrysomelidae. Superfamily Curculionoidea includes the families Curculionidae and Scolytidae.

The order Diptera includes the Suborders Nematocera, Brachycera, and Cyclorrhapha. Suborder Nematocera includes the families Tipulidae, Psychodidae, Culicidae, Ceratopogonidae, Chironomidae, Simuliidae, Bibionidae, and Cecidomyiidae. Suborder Brachycera includes the families Stratiomyidae, Tabanidae, Therevidae, Asilidae, Mydidae, Bombyliidae, and Dolichopodidae. Suborder Cyclorrhapha includes the Divisions Aschiza and Aschiza. Division Aschiza includes the families Phoridae, Syrphidae, and Conopidae. Division Aschiza includes the Sections Acalyptratae and Calyptratae. Section Acalyptratae includes the families Otitidae, Tephritidae, Agromyzidae, and Drosophilidae. Section Calyptratae includes the families Hippoboscidae, Oestridae, Tachinidae, Anthomyiidae, Muscidae, Calliphoridae, and Sarcophagidae.

The order Lepidoptera includes the families Papilionidae, Pieridae, Lycaenidae, Nymphalidae, Danaidae, Satyridae, Hesperiidae, Sphingidae, Saturniidae, Geometridae, Arctiidae, Noctuidae, Lymantriidae, Sesiidae, and Tineidae.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Insect pests of the invention for the major crops include: Maize: *Ostrinia nubilalis*, European corn borer; *Agrotis ipsilon*, black cutworm; *Helicoverpa zea*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; *Diabrotica virgifera*, western corn rootworm; *Diabrotica longicornis barberi*, northern corn rootworm; *Diabrotica undecimpunctata howardi*, southern corn rootworm; *Melanotus* spp., wireworms; *Cyclocephala borealis*, northern masked chafer (white grub); *Cyclocephala immaculata*, southern masked chafer (white grub); *Popillia japonica*, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus leucopterus*, chinch bug; *Melanoplus femurrubrum*, redlegged grasshopper; *Melanoplus sanguinipes*, migratory grasshopper; *Hylemya platura*, seedcorn maggot; *Agromyza parvicornis*, corn blot leafminer; *Anaphothrips obscrurus*, grass thrips; *Solenopsis milesta*, thief ant;

Tetranychus urticae, twospotted spider mite; Sorghum: *Chilo partellus*, sorghum borer; *Spodoptera frugiperda*, fall armyworm; *Helicoverpa zea*, corn earworm; *Elasmopalpus lignosellus*, lesser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis;* corn leaf aphid; *Sipha flava*, yellow sugarcane aphid; *Blissus leucopterus leucopterus*, chinch bug; *Contarinia sorghicola*, sorghum midge; *Tetranychus cinnabarinus*, carmine spider mite; *Tetranychus urticae*, twospotted spider mite; Wheat: *Pseudaletia unipunctata*, army worm; *Spodoptera frugiperda*, fall armyworm; *Elasmopalpus lignosellus*, lesser cornstalk borer; *Agrotis orthogonia*, western cutworm; *Elasmopalpus lignosellus*, lesser cornstalk borer; *Oulema melanopus*, cereal leaf beetle; *Hypera punctata*, clover leaf weevil; *Diabrotica undecimpunctata howardi*, southern corn rootworm; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarctata*, wheat bulb fly; *Frankliniella fusca*, tobacco thrips; *Cephus cinctus*, wheat stem sawfly; *Aceria tulipae*, wheat curl mite; Sunflower: *Suleima helianthana*, sunflower bud moth; *Homoeosoma electellum*, sunflower moth; *zygogramma exclamationis*, sunflower beetle; *Bothyrus gibbosus*, carrot beetle; *Neolasioptera murtfeldtiana*, sunflower seed midge; Cotton: *Heliothis virescens*, cotton budworm; *Helicoverpa zea*, cotton bollworm; *Spodoptera exigua*, beet armyworm; *Pectinophora gossypiella*, pink bollworm; *Anthonomus grandis*, boll weevil; *Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion thrips; *Franklinkiella fusca*, tobacco thrips; *Tetranychus cinnabarinus*, carmine spider mite; *Tetranychus urticae*, twospotted spider mite; Rice: *Diatraea saccharalis*, sugarcane borer; *Spodoptera frugiperda*, fall armyworm; *Helicoverpa zea*, corn earworm; *Colaspis brunnea*, grape colaspis; *Lissorhoptrus oryzophilus*, rice water weevil; *Sitophilus oryzae*, rice weevil; *Nephotettix nigropictus*, rice leafhopper; *Blissus leucopterus leucopterus*, chinch bug; *Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, cotton budworm; *Helicoverpa zea*, cotton bollworm; *Epilachna varivestis*, Mexican bean beetle; *Myzus persicae*, green peach aphid; *Empoasca fabae*, potato leafhopper; *Acrosternum hilare*, green stink bug; *Melanoplus femurrubrum*, redlegged grasshopper; *Melanoplus differentialis*, differential grasshopper; *Hylemya platura*, seedcorn maggot; *Sericothrips variabilis*, soybean thrips; *Thrips tabaci,* onion thrips; *Tetranychus turkestani*, strawberry spider mite; *Tetranychus urticae*, twospotted spider mite; Barley: *Ostrinia nubilalis*, European corn borer; *Agrotis ipsilon*, black cutworm; *Schizaphis graminum*, greenbug; *Blissus leucopterus leucopterus*, chinch bug; *Acrosternum hilare*, green stink bug; *Euschistus servus*, brown stink bug; *Delia platura*, seedcorn maggot; *Mayetiola destructor*, Hessian fly; *Petrobia latens*, brown wheat mite; Oil Seed Rape: *Brevicoryne brassicae*, cabbage aphid; *Phyllotreta cruciferae*, Flea beetle; *Mamestra configurata*, Bertha armyworm; *Plutella xylostella,* Diamond-back moth; *Delia* ssp., Root maggots.

Methods for Increasing Plant Yield

Methods for increasing plant yield are provided. The methods comprise introducing into a plant or plant cell a polynucleotide comprising a pesticidal sequence disclosed herein. As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a pesticidal protein disclosed herein. Expression of the pesticidal protein results in a reduced ability of a pest to infest or feed on the plant, thus improving plant yield.

The following examples are offered by way of illustration and not by way of limitation.

EXPERIMENTAL

EXAMPLE 1

Discovery of a Novel Pesticidal Genes from *Bacillus thuringiensis*

Novel pesticidal genes were identified from the bacterial strains listed in Table 1 using the following steps:

Preparation of extrachromosomal DNA from the strain, which includes plasmids that typically harbor delta-endotoxin genes Mechanical shearing of extrachromosomal DNA to generate size-distributed fragments Cloning of ~2 Kb to ~10 Kb fragments of extrachromosomal DNA Outgrowth of ~1500 clones of the extrachromosomal DNA Partial sequencing of the 1500 clones using primers specific to the cloning vector (end reads)

Identification of putative toxin genes via homology analysis via the MiDAS approach (as described in U.S. Patent Publication No. 20040014091, which is herein incorporated by reference in its entirety)

Sequence finishing (walking) of clones containing fragments of the putative toxin genes of interest

TABLE 1

List of novel genes isolated from *Bacillus thuringiensis*

| Gene | Strain | Nucleotide SEQ ID NO: | Amino Acid SEQ ID NO: | Percent identity to closest sequence in art | Closest sequence in art |
|---|---|---|---|---|---|
| axmi046[1] | ATX13026 | 1 | 61 | 54.30% | Cry4Aa1 |
| axmi048[2] | ATX13026 | 2 | 62 | 56.4% | Cry4Ba1 |
| axmi050[3] | ATX21049 | 3 | 63 | 17.9% | Cry21Ba1 |
| axmi051[4] | ATX21049 | 4 | 64 | 21.3% | Cry35Ac1 |
| axmi052[5] | ATX21049 | 5 | 65 | 19.70% | Cry35Aa1 |
| axmi053 | ATX21049 | 6 | 66 | 21.9% | Cry35Ac1 |
| axmi054 | ATX21049 | 7 | 67 | 20.1% | Cry35Ac1 |
| axmi055 | ATX12976 | 8 | 68 | 42.0% | Cry32Ca1 |
| axmi056 | ATX12976 | 9 | 69 | (homology to N-terminus) | BinA/BinB |
| axmi057 | ATX13058 | 10 | 70 | 73.1% | Cry32Da1 |
| axmi058 | ATX13058 | 11 | 71 | 26.8% | Cry6Ba1 |
| axmi059 | ATX13058 | 12 | 72 | 56.0% | Cry32Aa1 |
| axmi060 | ATX13058 | 13 | 73 | 54.6% | Cry32Aa1 |
| axmi061 | ATX13058 | 14 | 74 | 29.2% | Cry45Aa1 |
| axmi067 | ATX12974 | 15 | 75 | 36.3% | Cry32Da1 |
| axmi069 | ATX12997 | 17 | 77 | Some N-terminal homology | Cry32Ca1 |
| axmi071 | ATX12982 | 18 | 78 | 22.9% | Cry21Ba1 |
| axmi072 | ATX12982 | 19 | 79 | 16.4% | Mtx2 |
| axmi073 | ATX16042 | 20 | 80 | 15.3% | Mtx2 |
| axmi074 | ATX12993 | 21 | 81 | 43.8% | Cry21Ba1 |
| axmi075 | ATX12997 | 22 | 82 | 30.4% | Cry32Da1 |
| axmi087 | ATX13030 | 27 | 87 | 71.0% | Cry8Aa1 |
| axmi088 | ATX13039 | 28 | 88 | 26.2% | Cry21Ba1 |
| axmi093 | ATX13058 | 31 | 91 | 56.1% | Cry32Aa1 |

[1]Potential co-activity when expressed or paired with another toxin such as Axmi0014 or Axmi008
[2]Potential co-activity when expressed or paired with another toxin such as Axmi0014 or Axmi009
[3]An N-terminal domain homologous to a phospholipase C catalytic domain
[4]Potential co-activity when expressed or paired with another toxin such as Axmi052
[5]Potential co-activity when expressed or paired with another toxin such as Axmi051

TABLE 2

List of novel genes isolated from *Bacillus thuringiensis*

| Gene | Strain | Nucleotide SEQ ID NO: | Amino Acid SEQ ID NO: | Percent identity to closest sequence in art | Closest sequence in art |
|---|---|---|---|---|---|
| axmi079 | ATX12974 | 23 | 83 | 36.7% | Cry32Da1 |
| axmi080 | ATX12974 | 24 | 84 | 39.9% | Cry42Aa1 |
| axmi081 | ATX12974 | 25 | 85 | 68% | Orf3, described as 'C-terminal half of a Cry Protein' |
| axmi082 | ATX13056 | 26 | 86 | 47.8% | Cry32Da1 |
| axmi091 | ATX13053 | 29 | 89 | 35.3% | Cry8Ba1 |
| axmi092 | ATX13053 | 30 | 90 | 74.4% | Cry39Orf2 |
| axmi096 | ATX13007 | 32 | 92 | 29.6% | Cry32Da1 |
| axmi097 | ATX13007 | 33 | 93 | 29.3% | Cry32Da1 |
| axmi098 | ATX13007 | 34 | 94 | 56% | Cry41Ab1 |
| axmi099 | ATX13007 | 35 | 95 | 69% | axmi081 |
| | | | | 61% | axmi067 |
| | | | | 60% | axmi079 |
| | | | | 45% | axmi075 |
| | | | | 45% | Cry32Ca1 |
| axmi100 | ATX12990 | 36 | 96 | 77% | Cry9Ca1 |
| | | | | 76% | Cry9Ea1 |
| | | | | 74% | axmi002 |
| | | | | 72% | Cry9Bb1 |
| axmi101 | ATX13035 | 37 | 97 | 65% | Cry7Ba1 |
| | | | | 62% | axmi037 |
| | | | | 60% | axmi029 |
| | | | | 58% | Cry7Ab2 |
| axmi102 | ATX13056 | 38 | 98 | 86% | axmi082 |
| | | | | 65% | axmi093 |
| | | | | 58% | axmi059 |
| | | | | 56% | Cry32Aa1 |
| axmi103 | ATX13056 | 39 | 99 | 64% | axmi082 |
| | | | | 58% | Cry32Da1 |
| | | | | 56% | axmi093 |
| | | | | 52% | axmi059 |
| axmi104 | ATX13058 | 40 | 100 | 19.3% | axmi020 |
| | | | | 18.3% | Cry21Ba1 |
| | | | | 17.1% | Cry5Ba1 |
| | | | | 17.1% | Cry44Aa |
| axmi107 | ATX13007 | 41 | 101 | 35% | Vip1Aa2 |
| | | | | 34% | Vip1Da1 |
| axmi108 | ATX12984 | 42 | 102 | 90% | Cry45Aa1 |
| | | | | 25% | Cry23Aa1 |
| axmi109 | ATX12984 | 43 | 103 | 38% | Cry45Aa1 |
| axmi110 | ATX12984 | 44 | 104 | 43% | Cry32Aa1 |
| axmi111 | ATX12984 | 45 | 105 | 34% | Cry41Ab1 |
| axmi112 | ATX12987 | 46 | 106 | 96% | Cry1Ab |
| axmi114 | ATX14903 | 47 | 107 | 85.8% | axmi043 |
| | | | | 85.8% | axmi028 |
| | | | | 56.7% | axmi037 |
| | | | | 57.2% | Cry7Ca1 |
| | | | | 56.3% | Cry7Ab2 |
| axmi116 | ATX12975 | 48 | 108 | 53.5% | Cry7Ba1 |
| | | | | 53.2% | axmi114 |
| | | | | 53.1% | axmi028 |
| | | | | 53% | axmi043 |
| | | | | 52.3% | Cry7Ca1 |
| | | | | 50.3% | Cry7Ab1 |
| axmi117 | ATX13029 | 49 | 109 | 92.2% | Cry22Ba1 |
| | | | 110 | 48.2% | Cry22Aa1 |
| | | | | 47.1% | Cry22Ab1 |
| axmi118 | ATX12989 | 50 | 111 | 25.3% | axmi011 |
| | | | | 22.2% | Mtx2 |
| axmi119 | ATX13029 | 51 | 112 | 28.8% | axmi027 |
| | | | | 27.8% | axmi066 |
| | | | | 27.5% | Cry2Ae1 |
| | | | | 26.5% | axmi076 |
| | | | | 26.2% | Cry18Aa1 |
| axmi120 | ATX13034 | 52 | 113 | 50% | Cry8Aa1 |
| | | 53 | 114 | 49.5% | axmi087 |
| | | 54 | 115 | 49.1% | Cry8Bb1 |
| | | | | 47.8% | Cry8Bc1 |

EXAMPLE 2

Discovery of Novel Pesticidal Genes from *Bacillus thuringiensis*

Novel pesticidal genes were identified from the strains listed in Table 2 using the MiDAS approach as described in U.S. Patent Publication No. 20040014091, which is herein incorporated by reference in its entirety, using the following steps:

Preparation of extrachromosomal DNA from the strain. Extrachromosomal DNA contains a mixture of some or all of the following: plasmids of various size; phage chromosomes; genomic DNA fragments not separated by the purification protocol; other uncharacterized extrachromosomal molecules.

Mechanical or enzymatic shearing of the extrachromosomal DNA to generate size-distributed fragments.

Sequencing of the fragmented DNA

Identification of putative toxin genes via homology and/or other computational analyses.

When required, sequence finishing of the gene of interest by one of several PCR or cloning strategies (e.g. TAIL-PCR).

TABLE 2-continued

List of novel genes isolated from *Bacillus thuringiensis*

| Gene | Strain | Nucleotide SEQ ID NO: | Amino Acid SEQ ID NO: | Percent identity to closest sequence in art | Closest sequence in art |
|---|---|---|---|---|---|
| | | | | 47.8% | Cry8Da1 |
| | | | | 47% | Cry8Ba1 |
| | | | | 45.8% | Cry8Ca1 |
| axmi121 | ATX13034 | 55 | 116 | 51.1% | axmi013 |
| | | | | 47.9% | Mtx3 |
| axmi122 | ATX13034 | 56 | 117 | 23.1% | axmi013 |
| | | | | 22.8% | Mtx2 |
| | | | | 22.1% | Mtx3 |
| | | | | 21.4% | axmi095 |
| axmi123 | ATX12989 | 57 | 118 | 26.7% | Cry33Aa1 |
| | | | | 22.7% | Cry23Aa1 |
| | | | | 21.8% | Cry15Aa1 |
| | | | | 19% | axmi061 |
| axmi124 | ATX9387 | 58 | 119 | 57.6% | axmi088 |
| | | | | 29.1% | axmi040 |
| | | | | 28.4% | axmi049 |
| | | | | 27.1% | Cry5Ab1 |
| | | | | 26.5% | Cry21Ba1 |
| | | | | 26.1% | Cry12Aa1 |
| | | | | 25.6% | axmi074 |
| | | | | 24.4% | axmi031 |
| axmi125[7] | ATX13029 | 59 | 120 | 38.4% | Cry10Aa1 |
| | | | | 36.7% | Cry10Aa2 |
| | | | | 31.3% | axmi007 |
| | | | | 31% | axmi006 |
| axmi126[8] | ATX13029 | 60 | 121 | 82.6% | axmi047 |
| | | | | 81.5% | axmi084 |
| | | | | 80.9% | axmi086 |
| | | | | 80.9% | axmi090 |
| | | | | 80.5% | axmi046 |
| | | | | 79.2% | axmi048 |
| | | | | 75.3% | axmi092 |
| | | | | 65% | Cry4Ba1 |
| | | | | 64.1% | Cry4Aa1 |
| axmi127 | ATX13034 | 124 | 133 | 58% | Cry8Da1 |
| axmi129 | ATX13015 | 125 | 134 | 63% | Cry8Aa1 |
| axmi164 | ATX22201 | 126 | 135 | 77% | Cry8Aa1 |
| axmi151 | ATX12998 | 127 | 136 | 61% | Cry7Ba |
| axmi161 | ATX12998 | 128 | 137 | 52% | Cry7Ca1 |
| axmi183 | ATX14775 | 129 | 138 | 69% | Cry9Eb1 |
| axmi132 | ATX13029 | 130 | 139 | 55% | Cry4Ba |
| axmi138 | ATX13027 | 131 | 140 | 47% | Cry41Aa1 |
| axmi137 | ATX9387 | 132 | 141 | 61% | Axmi075 |

[1]This gene is the N-terminal portion of a split cry gene and is paired in its native context with Axmi126, which represents the C-terminal portion of the split cry pair. These genes may act as co-toxins and may show enhanced, novel, or altered activity when co-expressed or fused. The intervening region between Axmi125 and the downstream Axmi126 is set forth in SEQ ID NO: 122.
[2]This gene is the C-terminal portion of a split cry gene and is paired in its native context with Axmi125, which represents the N-terminal portion of the split cry pair. These genes may act as co-toxins and may show enhanced, novel, or altered activity when co-expressed or fused.

EXAMPLE 3

Discovery of a Novel Toxin Gene Axmi068 from *Bacillus thuringiensis* Strain ATX13046

The strain encoding axmi068 was identified as follows:
Sequence information from known or suspected toxin genes was used to generate an alignment representing conserved and partially conserved DNA sequences within a group (family) of toxins.
Polymerase chain reaction (PCR) primers were designed to selectively amplify one or more toxin family members based on the aligned sequence.
DNA isolated from bacterial strains was screened by PCR to identify strains containing putative homologs to the target gene family.
PCR products were sequenced to select a strain containing a gene of interest.
The complete gene sequence was identified from the selected strain via the MiDAS genomics approach (U.S. Patent Publication No. 20040014091) as follows:
Preparation of extrachromosomal DNA from the strain. Extrachromosomal DNA contains a mixture of some or all of the following: plasmids of various size; phage chromosomes; genomic DNA fragments not separated by the purification protocol; other uncharacterized extrachromosomal molecules.
Mechanical or enzymatic shearing of the extrachromosomal DNA to generate size-distributed fragments.
Cloning of the extrachromosomal DNA fragments into a plasmid vector.
Growth and purification of the cloned of the extrachromosomal DNA.
Partial sequencing of the clones.
Identification of putative toxin genes via homology and/or other computational analyses.
When required, sequence finishing (walking) of clones containing sequence of the putative toxin genes of interest.
The nucleotide sequence for axmi068 is set forth in SEQ ID NO:16 and the amino acid sequence for AXMI068 is set forth in SEQ ID NO:76.

| Gene and Protein Characteristics | |
|---|---|
| Gene length, DNA base pairs: | 1,791 |
| Protein length, amino acid residues: | 597 |
| Estimated protein molecular weight, Da: | 66,495 |
| Known homologs and approximate percent identity: | Cry1Id1, 71.4% |

EXAMPLE 4

Expression in *Bacillus*

The insecticidal gene disclosed herein is amplified by PCR, and the PCR product is cloned into the *Bacillus* expression vector pAX916, or another suitable vector, by methods well known in the art. The resulting *Bacillus* strain, containing the vector with axmi gene is cultured on a conventional growth media, such as CYS media (10 g/l Bacto-casitone; 3 g/l yeast extract; 6 g/l KH$_2$PO$_4$; 14 g/l K$_2$HPO$_4$; 0.5 mM MgSO$_4$; 0.05 mM MnCl$_2$; 0.05 mM FeSO$_4$), until sporulation is evident by microscopic examination. Samples are prepared and tested for activity in bioassays.

EXAMPLE 5

Construction of Synthetic Sequences

In one aspect of the invention, synthetic axmi sequences were generated. These synthetic sequences have an altered DNA sequence relative to the parent axmi sequence, and encode a protein that is collinear with the parent AXMI protein to which it corresponds, but lacks the C-terminal "crystal domain" present in many delta-endotoxin proteins. Synthetic genes are presented in Table 3.

TABLE 3

| Wildtype Gene Name | Synthetic Gene Name | SEQ ID NO: |
|---|---|---|
| axmi050 | axmi050bv01 | 142 |
|  | axmi050bv02 | 143 |
| axmi051 | axmi051bv01 | 144 |
|  | axmi051bv02 | 145 |
| axmi052 | axmi052bv01 | 146 |
|  | axmi052bv02 | 147 |
| axmi053 | axmi053bv01 | 148 |
|  | axmi053bv02 | 149 |
| axmi054 | axmi054bv01 | 150 |
|  | axmi054bv02 | 151 |
| axmi055 | axmi055bv01 | 152 |
|  | axmi055bv02 | 153 |
| axmi056 | axmi056bv01 | 154 |
|  | axmi056bv02 | 155 |
| axmi057 | axmi057bv01 | 156 |
|  | axmi057bv02 | 157 |
| axmi058 | axmi058bv01 | 158 |
|  | axmi058bv02 | 159 |
| axmi059 | axmi059_1bv01 | 160 |
|  | axmi059_1bv02 | 161 |
|  | axmi059_2bv01 | 162 |
|  | axmi059_2bv02 | 163 |
| axmi060 | axmi060bv01 | 164 |
|  | axmi060bv02 | 165 |
| axmi061 | axmi061bv01 | 166 |
|  | axmi061bv02 | 167 |
| axmi067 | axmi067bv01 | 168 |
|  | axmi067bv02 | 169 |
| axmi069 | axmi069bv01 | 170 |
|  | axmi069bv02 | 171 |
| axmi071 | axmi071bv01 | 172 |
|  | axmi071bv02 | 173 |
| axmi072 | axmi072bv01 | 174 |
|  | axmi072bv02 | 175 |
| axmi073 | axmi073bv01 | 176 |
|  | axmi073bv02 | 177 |
| axmi074 | axmi074bv01 | 178 |
|  | axmi074bv02 | 179 |
| axmi075 | axmi075bv01 | 180 |
|  | axmi075bv02 | 181 |
| axmi079 | axmi079bv01 | 182 |
|  | axmi079bv02 | 183 |
| axmi080 | axmi080bv01 | 184 |
|  | axmi080bv02 | 185 |
| axmi082 | axmi082bv01 | 186 |
|  | axmi082bv02 | 187 |
| axmi087 | axmi087_1bv01 | 188 |
|  | axmi087_1bv02 | 189 |
|  | axmi087_2bv01 | 190 |
|  | axmi087_2bv02 | 191 |
| axmi088 | axmi088bv01 | 192 |
|  | axmi088bv02 | 193 |
| axmi091 | axmi091bv01 | 194 |
|  | axmi091bv02 | 195 |
| axmi093 | axmi093bv01 | 196 |
|  | axmi093bv02 | 197 |
| axmi096 | axmi096bv01 | 198 |
|  | axmi096bv02 | 199 |
| axmi097 | axmi097_1bv01 | 200 |
|  | axmi097_1bv02 | 201 |
|  | axmi097_2bv01 | 202 |
|  | axmi097_2bv02 | 203 |
| axmi098 | axmi098bv01 | 204 |
|  | axmi098bv02 | 205 |
| axmi100 | axmi100bv01 | 206 |
|  | axmi100bv02 | 207 |
|  | optaxmi100v01 | 282 |
|  | optaxmi100v02 | 283 |
| axmi101 | axmi101_1bv01 | 208 |
|  | axmi101_1bv02 | 209 |
|  | axmi101_2bv01 | 210 |
|  | axmi101_2bv02 | 211 |
| axmi102 | axmi102bv01 | 212 |
|  | axmi102bv02 | 213 |
| axmi103 | axmi103bv01 | 214 |
|  | axmi103bv02 | 215 |
| axmi104 | axmi104bv01 | 216 |
|  | axmi104bv02 | 217 |
| axmi107 | axmi107bv01 | 218 |
|  | axmi107bv02 | 219 |
| axmi108 | axmi108bv01 | 220 |
|  | axmi108bv02 | 221 |
| axmi109 | axmi109bv01 | 222 |
|  | axmi109bv02 | 223 |
| axmi110 | axmi110bv01 | 224 |
|  | axmi110bv02 | 225 |
| axmi111 | axmi111bv01 | 226 |
|  | axmi111bv02 | 227 |
| axmi112 | axmi112bv01 | 228 |
|  | axmi112bv02 | 229 |
| axmi114 | axmi114bv01 | 230 |
|  | axmi114bv02 | 231 |
| axmi116 | axmi116bv01 | 232 |
|  | axmi116bv02 | 233 |
| axmi117 | axmi117bv01 | 234 |
|  | axmi117bv02 | 235 |
| axmi118 | axmi118bv01 | 236 |
|  | axmi118bv02 | 237 |
| axmi119 | axmi119bv01 | 238 |
|  | axmi119bv02 | 239 |
| axmi120 | axmi120_1bv01 | 240 |
|  | axmi120_1bv02 | 241 |
|  | axmi120_2bv01 | 242 |
|  | axmi120_2bv02 | 243 |
| axmi121 | axmi121bv01 | 244 |
|  | axmi121bv02 | 245 |
| axmi122 | axmi122bv01 | 246 |
|  | axmi122bv02 | 247 |
| axmi123 | axmi123bv01 | 248 |
|  | axmi123bv02 | 249 |
| axmi124 | axmi124bv01 | 250 |
|  | axmi124bv02 | 251 |
| axmi125 | axmi125bv01 | 252 |
|  | axmi125bv02 | 253 |
| axmi127 | axmi127_1bv01 | 254 |
|  | axmi127_1bv02 | 255 |
|  | axmi127_2bv01 | 256 |
|  | axmi127_2bv02 | 257 |
| axmi129 | axmi129_1bv01 | 258 |
|  | axmi129_1bv02 | 259 |
|  | axmi129_2bv01 | 260 |
|  | axmi129_2bv02 | 261 |
| axmi137 | axmi137bv01 | 262 |
|  | axmi137bv02 | 263 |
| axmi138 | axmi138bv01 | 264 |
|  | axmi138bv02 | 265 |
| axmi151 | axmi151_1bv01 | 266 |
|  | axmi151_1bv02 | 267 |
|  | axmi151_2bv01 | 268 |
|  | axmi151_2bv02 | 269 |
| axmi161 | axmi161_1bv01 | 270 |
|  | axmi161_1bv02 | 271 |
|  | axmi161_2bv01 | 272 |
|  | axmi161_2bv02 | 273 |
| axmi164 | axmi164_1bv01 | 274 |
|  | axmi164_1bv02 | 275 |
|  | axmi164_2bv01 | 276 |
|  | axmi164_2bv02 | 277 |
| axmi183 | axmi183_2bv01 | 278 |
|  | axmi183_2bv02 | 279 |
|  | axmi183bv01 | 280 |
|  | axmi183bv02 | 281 |

In another aspect of the invention, modified versions of synthetic genes are designed such that the resulting peptide is targeted to a plant organelle, such as the endoplasmic reticulum or the apoplast. Peptide sequences known to result in targeting of fusion proteins to plant organelles are known in the art. For example, the N-terminal region of the acid phosphatase gene from the White Lupin *Lupinus albus* (Genebank ID GI:14276838; Miller et al. (2001) Plant Physiology 127: 594-606) is known in the art to result in endoplasmic reticulum targeting of heterologous proteins. If the resulting fusion protein also contains an endoplasmic retention sequence comprising the peptide N-terminus-lysine-aspartic acid-glutamic acid-leucine (i.e. the "KDEL" motif (SEQ ID NO:123) at the C-terminus, the fusion protein will be targeted to the endoplasmic reticulum. If the fusion protein lacks an endoplasmic reticulum targeting sequence at the C-terminus, the protein will be targeted to the endoplasmic reticulum, but will ultimately be sequestered in the apoplast.

EXAMPLE 6

Expression of axmi100 in *E. coli* and *Bacillus*

The complete ORF of axmi100 (3.45 kb which encode 1156 amino acid long protein) was cloned into an *E. coli* expression vector based on pRSF1b (to give pAX5445) and *Bacillus* vector based on pAX916 (to give pAX5444). The resulting clones were confirmed by restriction analysis and finally, by complete sequencing of the cloned gene.

For expression in *E. coli*, BL21 *DE3 was transformed with pAX5445. Single colony was inoculated in LB supplemented with kanamycin and grown overnight at 37° C. Next day, fresh medium was inoculated in duplicate with 1% of overnight culture and grown at 37° C. to logarithmic phase. Subsequently, cultures were induced with 1 mM IPTG for 3 hours at 37° C. or overnight at 20° C. Each cell pellet was suspended in 50 mM sodium carbonate buffer, pH 10.5 supplemented with 1 mM DTT and sonicated. Analysis by SDS-PAGE detected expression of a 130 kD protein corresponding to Axmi100.

For expression in *Bacillus*, *Bacillus thuringiensis* was transformed with pAX5444 and a single colony was grown in CYS-glu medium for 3 days to sporulation. Cell pellet was then extracted with 50 mM sodium carbonate buffer, pH 10.5 supplemented with 1 mM DTT. Soluble fraction showed presence of a 130 kD Axmi100 protein along with several smaller molecular weight protein bands due to processing of Axmi100. Trypsinization of Axmi100 gave 2 distinct protein bands of about 65 kD and 55 kD.

EXAMPLE 7

Bioassay of Axmi100

Preparation of Samples:

Cell free extracts from cells expressing AXMI-100 were typically resuspended in 50 mM sodium carbonate buffer, pH 10.5, typically with inclusion of 1 mM DTT as a reducing agent. Samples with and without trypsin were prepared for bioassay testing.

Bioassay Methodology Overview:

24-Well tissue culture plates (Corning) were given 1 ml of multi-species diet (Bio-Serv) and allowed to solidify. Once solidified, 40 μl of protein sample was placed on the diet surface of each well and allowed to soak in/dry at room temperature. Depending upon the experiment, either ECB egg masses, ten neonate larvae or a single neonate larvae were placed in each well. Plates were sealed with gas-permeable membranes (Research Products International) and incubated at 25° C. and 90% RH. After five or seven days (experiment dependent), samples were scored visually compared to a buffer only or non-transformed extract control.

Strong activity of AXMI-100 was observed on European Corn Borer and Tobacco Budworm. Activity on black cutworm was observed at high protein concentrations. Some activity was also observed at high concentrations on Velvet Bean caterpillar, but the activity of both black cutworm and velvet bean caterpillar was less pronounced and more variable than for the other insects tested. Trypsinization of Axmi100 gave 2 distinct protein bands of about 65 kD and 55 kD, and did not appear to be required for activity of AXMI-100.

EXAMPLE 8

Additional Assays for Pesticidal Activity

The ability of a pesticidal protein to act as a pesticide upon a pest is often assessed in a number of ways. One way well known in the art is to perform a feeding assay. In such a feeding assay, one exposes the pest to a sample containing either compounds to be tested, or control samples. Often this is performed by placing the material to be tested, or a suitable dilution of such material, onto a material that the pest will ingest, such as an artificial diet. The material to be tested may be composed of a liquid, solid, or slurry. The material to be tested may be placed upon the surface and then allowed to dry. Alternatively, the material to be tested may be mixed with a molten artificial diet, then dispensed into the assay chamber. The assay chamber may be, for example, a cup, a dish, or a well of a microtiter plate.

Assays for sucking pests (for example aphids) may involve separating the test material from the insect by a partition, ideally a portion that can be pierced by the sucking mouth parts of the sucking insect, to allow ingestion of the test material. Often the test material is mixed with a feeding stimulant, such as sucrose, to promote ingestion of the test compound.

Other types of assays can include microinjection of the test material into the mouth, or gut of the pest, as well as development of transgenic plants, followed by test of the ability of the pest to feed upon the transgenic plant. Plant testing may involve isolation of the plant parts normally consumed, for example, small cages attached to a leaf, or isolation of entire plants in cages containing insects.

Other methods and approaches to assay pests are known in the art, and can be found, for example in Robertson, J. L. & H. K. Preisler. 1992. *Pesticide bioassays with arthropods*. CRC, Boca Raton, Fla. Alternatively, assays are commonly described in the journals "Arthropod Management Tests" and "Journal of Economic Entomology" or by discussion with members of the Entomological Society of America (ESA).

EXAMPLE 9

Bioassay of Axmi079 and Axmi082

Gene Expression and Purification

The DNA regions encoding the toxin domains of Axmi079 and Axmi082 were separately cloned into an *E. coli* expression vector pMAL-C4x behind the malE gene coding for Maltose binding protein (MBP). These in-frame fusions resulted in MBP-Axmi fusion proteins expression in *E. coli*.

For expression in *E. coli*, BL21 *DE3 was transformed with individual plasmids. Single colony was inoculated in LB supplemented with carbenicillin and glucose, and grown overnight at 37° C. The following day, fresh medium was inoculated with 1% of overnight culture and grown at 37° C. to logarithmic phase. Subsequently, cultures were induced with 0.3 mM IPTG for overnight at 20° C. Each cell pellet was suspended in 20 mM Tris-Cl buffer, pH 7.4+200 mM NaCl+1 mM DTT+protease inhibitors and sonicated. Analysis by SDS-PAGE confirmed expression of fusion proteins.

Total cell free extracts were run over amylose column attached to FPLC for affinity purification of MBP-axmi fusion proteins. Bound fusion protein was eluted from the resin with 10 mM maltose solution. Purified fusion proteins were then cleaved with either Factor Xa or trypsin to remove the amino terminal MBP tag from the Axmi protein. Cleavage and solubility of the proteins was determined by SDS-PAGE.

Insect Bioassays

Cleaved proteins were tested in insect assays with appropriate controls. A 5-day read of the plates showed following activities of these proteins.

| Axmi protein | MBP-Axmi fusion protein cleaved with | Activity on insects |
|---|---|---|
| Axmi079 | Factor Xa, trypsin | Diamondback moth |
| Axmi082 | Factor Xa, trypsin | Diamondback moth |

Additional Insect Bioassay Results:

| Gene | sample tested | C. elegans | VBC* | DBM* | SWCB* | CPB* | ECB* | Hz* | Hv* |
|---|---|---|---|---|---|---|---|---|---|
| Axmi50 | crude extract | 3, 3 | | | | | | | |
| Axmi52 | purified, digested | | 1, 0% | | | | | | |
| Axmi58 | purified, digested | | | 4, 100% | | | | | |
| Axmi68 | crude extract | 3, 2 | | | | | | | |
| Axmi88 | purified, digested | | | 1, 0% | 1, 0% | | | | |
| Axmi93 | purified, digested | 20% | | | | | | | |
| Axmi97 | purified, digested | | | | | 1, 0% | | | |
| Axmi102 | crude extract | | | 4, 100% | | | 3, 75% | | |
| Axmi112 | purified, digested | | 3, 0% | 4, 100% | 3, 25% | | 3, 75% | 1, 0% | 3, 0% |
| Axmi117 | purified, digested | | | 1, 25% | | | | | |
| Axmi100 | purified, digested | | | 4, 100% | | | 4, 100% | | |

VBC = Velvetbean caterpillar
DBM = diamondback moth
SWCB = Southwestern corn borer
CPB = Colorado potato beetle
ECB = European corn borer
Hz = *Helicoverpa zea*
Hv = *Heliothis virescens*
*= represented as stunt and mortality percent where stunting is scored according to the following scale:

| Score | Definition |
|---|---|
| 0 | No Activity |
| 1 | Slight, non-uniform stunt |
| 2 | Non-uniform stunt |
| 3 | Uniform stunt |
| 4 | Uniform stunt with mortality (expressed as a percentage) |
| 5 | Uniform stunt with 100% mortality |

EXAMPLE 10

Vectoring of the Pesticidal Genes of the Invention for Plant Expression

Each of the coding regions of the genes of the invention are connected independently with appropriate promoter and terminator sequences for expression in plants. Such sequences are well known in the art and may include the rice actin promoter or maize ubiquitin promoter for expression in monocots, the *Arabidopsis* UBQ3 promoter or CaMV 35S promoter for expression in dicots, and the nos or PinII terminators. Techniques for producing and confirming promoter—gene—terminator constructs also are well known in the art.

EXAMPLE 11

Transformation of the Genes of the Invention into Plant Cells by *Agrobacterium*-Mediated Transformation Ears are collected 8-12 days after pollination. Embryos are isolated from the ears, and those embryos 0.8-1.5 mm in size are used for transformation. Embryos are plated scutellum side-up on a suitable incubation media, and incubated overnight at 25° C. in the dark. However, it is not necessary per se to incubate the embryos overnight. Embryos are contacted with an *Agrobacterium* strain containing the appropriate vectors for Ti plasmid mediated transfer for 5-10 min, and then plated onto co-cultivation media for 3 days (25° C. in the dark). After co-cultivation, explants are transferred to recovery period media for five days (at 25° C. in the dark). Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated as known in the art. The resulting shoots are allowed to root on rooting media, and the resulting plants are transferred to nursery pots and propagated as transgenic plants.

EXAMPLE 12

Transformation of Maize Cells with the Pesticidal Genes of the Invention

Maize ears are collected 8-12 days after pollination. Embryos are isolated from the ears, and those embryos 0.8-1.5 mm in size are used for transformation. Embryos are plated scutellum side-up on a suitable incubation media, such as DN62A5S media (3.98 g/L N6 Salts; 1 mL/L (of 1000× Stock) N6 Vitamins; 800 mg/L L-Asparagine; 100 mg/L Myo-inositol; 1.4 g/L L-Proline; 100 mg/L Casaminoacids; 50 g/L sucrose; 1 mL/L (of 1 mg/mL Stock) 2,4-D), and incubated overnight at 25° C. in the dark.

The resulting explants are transferred to mesh squares (30-40 per plate), transferred onto osmotic media for 30-45 minutes, then transferred to a beaming plate (see, for example, PCT Publication No. WO/0138514 and U.S. Pat. No. 5,240,842).

DNA constructs designed to express the genes of the invention in plant cells are accelerated into plant tissue using an aerosol beam accelerator, using conditions essentially as described in PCT Publication No. WO/0138514. After beaming, embryos are incubated for 30 min on osmotic media, then placed onto incubation media overnight at 25° C. in the dark. To avoid unduly damaging beamed explants, they are incubated for at least 24 hours prior to transfer to recovery media. Embryos are then spread onto recovery period media, for 5 days, 25° C. in the dark, then transferred to a selection media. Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated by methods known in the art. The resulting shoots are allowed to root on rooting media, and the resulting plants are transferred to nursery pots and propagated as transgenic plants.

Materials

| DN62A5S Media | | |
| --- | --- | --- |
| Components | per liter | Source |
| Chu'S N6 Basal Salt Mixture (Prod. No. C 416) | 3.98 g/L | Phytotechnology Labs |
| Chu's N6 Vitamin Solution (Prod. No. C 149) | 1 mL/L (of 1000x Stock) | Phytotechnology Labs |
| L-Asparagine | 800 mg/L | Phytotechnology Labs |
| Myo-inositol | 100 mg/L | Sigma |
| L-Proline | 1.4 g/L | Phytotechnology Labs |
| Casaminoacids | 100 mg/L | Fisher Scientific |
| Sucrose | 50 g/L | Phytotechnology Labs |
| 2,4-D (Prod. No. D-7299) | 1 mL/L (of 1 mg/mL Stock) | Sigma |

Adjust the pH of the solution to pH to 5.8 with 1N KOH/1N KCl, add Gelrite (Sigma) to 3 g/L, and autoclave. After cooling to 50° C., add 2 ml/L of a 5 mg/ml stock solution of Silver Nitrate (Phytotechnology Labs). Recipe yields about 20 plates.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (283 sequences)

SEQ ID NO: 1 - DNA, 1683 bp, Bacillus thuringiensis
atgtatatcaataagatgaaaaataaattaaaactagaaacgacagattatgaaatcgatcaagcggctatttctatagaatgtatgtcagatgaacaaaatccacagggaaaaatgatgttatgggaggacatcaaacaggcaaaacaactcagtcaatctcgtaatttactccaaaatggggacttgggagacttttatggaagtaattggacattcggtaatgatattatcataggatccaataatcctatttttaaagggaaatttcttcagatgcgtggagcacgagacgtatatggaaccatatttccaacctatatttatcaaaaaatagaggaatccaaattaaaaccatatacacgttatagagtaagagggtttgtgggaagtagtaaagatctgaaattaatggtaacacgttacgggaaagaaattgacgccattatggatgttccaaatgatttagtctatacgcagcctaacccttcatgcggagattatcgctgtgaatcatcgtcccagtatatgaaccaagggtatcctacaccagtaatagatggatatgcttctaataggtatgcatgcccgtcaaaccgaggtaaaaagcatgtgaagtgtcacgatcgtcatccatttgattttcatattgacaccggagaagtagatacaaatacaaacgtaggtatcgatgtcttatttaaaatttccaatccagatggatacgctacattagggaatctagaagtaattgaagaaagaccactaacagacgaagcattggcacatgtgaaacagaaagaaaagaaatggaatcaacatatagagaaagcgcgaatggaaacacaacaagcctatgatccagcaaaacaagcagtagatgcattattcacaaatgcacaaggtgaagagttacactatcatattactttagatcatattcagaacgccaatcagttggtacagtcgattccttatgtacaccatgcttggttaccggatgctccaggtatgaactatgatggatatcaagggttaaacgcacgtatcatgcaagcttataatttatatgctgcgcgaaatgtcatcacaaatggtgactttacacaaggattacagggatggcatgtaacaggaaaggcagcggtacaacaaatggatggagcttctgtattagttttatcaaactggagtgcgggggtatctcagaatctgcatgtccaagatcaccatggctatgtgttacgtgtgattgccaaaaaagaaggacctggaaaagggtatgtaacgatgatggattgtaacggcaatcagaaaacactgaagttcacttcttgtgaagaaggatatatgacaaaaacagtagaggtattcccagaaaatgatcgtgtacggattgaaataggagaaaccgaaggtatattttatatagatagcatcgagttgctttgtatgcaaggatatactagcaataataacccgcacacgggtaataggtatgagcaaagttataatggaaattataatcagaatacgagcgatatgtatgagcaagaatatagtagcaactataaccaagactctagtagtatgtataatcaaaattatactaacaatgatgaccaatattccggttgcacatgtaaccaagggcataactctgactgtacatgtaaccgttaa

SEQ ID NO: 2 - DNA, 1614 bp, Bacillus thuringiensis
atgtttagaagtggtgcgaaacatacgttgaaaatagaaacgacagattatgaattagatcaagtggcaatttctatagaatgtatgccagatgaacaaaatccacaaaaaaaattaatgttatgggatgagataaaacaggcaaaacaacttagccggtctcgtaatttactccacaatggtgattttgaggatttatttagaggctggacaacaagtgcccatattacgattcaggcgaataatctcatttttaaagggaattatcttaatatacccggagcagaagatattgatgggacactattctcaacctatgtctatcaaaaaatagatgaatctaaattaaaaccatatacacgttatcgagtaagaggatttatgggaagtagtaaagatctaaaattagtgataacacgttacgggaaagaaattgatgctagtatgaatgttccaaatgatttggcctatatgcagcctagttcttcatgtggagattatcgctgtgaatcagcgtcacagtatgtgagccaagggtatcctacgccagtaacagatggatatgcttctgatatgtatgcatgcccgtcaaatctagatagaagacatgtgaagtgtcacgatcgtcatccgtttgattttcatattgacaccggagaagtagatacaaatacaaacgtaggtattgatgttttatttaaaatttctaatcccgatggatacgctacattaggaaatctagaagtgattgaagaaggagcactaacaggcgaagcattggcacatgtgaaacataaggaaaagaaatggaatcaacacatggagaaaaagcgaatggaaacacaacaggcttatgatctagcaaaacaggcagtagatggattatttacaagtacacaagagttacaatatcatattactttagattatattaagaatgccgatcagttggtacagtcgattccctatgtacatcatgattggttaccggatgctccaggtatgaactatgatttatataacaatttaaaggtacgtatagaacaagcacgctatttatacgatgcacgaaatgccatcacaaatggtgactttacacaaggattacagggatggcacgcaacaggaaatgccgcggtacaacaaatggatggagctttagtattagttctatcaaactggagtgccggggtatctcagaatctgcatgcccaagatcatcatggatatatgttacgtgtgattgccaaaaaagaaggtcctggaaaagggtatgtaacgatgatggattgtaatggaaagcaggaaacacttaagttcacttcttgtgaagaaggatatatgacaaaaacagtagaggtattcccggaaagtgatcgtgtgcgaatagaaattggagaaaccgaaggtacgttttatatagatagcatcgagttgctttgtatgcaaggatatgataacaataataacccgcacacgggtaatatgtatgagcaaagttataatggaaattataatcaaaattatactaacaatgatgacctgcattccggttgcacatgtaaccaagggcataactctggctgtacatgtaatcaaggatataaccgttaa

SEQ ID NO: 3 - DNA, 4017 bp, Bacillus thuringiensis
atggcattaacaccgtattatttgtctgatgatacaattgatacgcacaatccgaattggatgaaagatatggacgattatgttcttttgagtcaaatttctattccaggtacacatgaaacaatggctaaaaatccatggggtcatgatattcttccaggtaataattttattggtgtatgtcaaagtttatcattatcagcacaattaaatgctggtattcgttatatagatattcgttgttattatgaatcgagtaaaagtgacgctggaatttcagcgccatcattttcaattcatcatgaagttataaatgaaaataaggcattaggagcagatgtattatctgttgttgtatcgtttttacaaaataatccatcagaaacaattttaatgcgtattaaacaagaaaagactaaagaaagtgatactacattttcaaacacatttcaaaaatatgtggatcaatataaatcttatttttgggattcaaacaaccagactagtattcctaaattaggagaagtaagagggaaaattgttgttttatatgatattggtgatcacaagtttggtttgccttattcagatcctagacttttttgtactcaagataattattctttttctacaaattggcatcaatatacaaaatgggaagaggtcaaaactcatttaactcaagcggatgaacaatatcaatcaaatcaagaggatccacaaaataatatactgaaaagtgcaatatttttaaactatttaagtggtagtggtaatcttacttaccctttttttgttgctagtgggcatgtagatcctggaaccaacggtggtcgtctatggactggtttaacaactcttacaagtaaacataaatggcctgattttcctagattaaatggttttttaggattatattccatttattttgaagggattaataacttatgtggtgatcgtttagaagactatcgttatgttggaattgtagcagctgattttcctggtgcaggattaattgagaaaattatcgagataaacaagacccatccaccacagattttaaaagtagctccacctgaaagtatgacaatttcaaaaacatatcaactttctgataatgagggtcaaaaagttttatggaataacactgattttaatcagaatcctcaagggatttttatagaatttaacaattctggaattgagtctgaattaatgtttttaaaagatggaactactgtttctagtttttccacaaatattgatgttatttctcataaaattttaactttagagtttgatacaatagttgtaaatcttcctaataatagcaaatcatcttctggaaccatttcagcaactctttattattataaatctccttgggcaagtacatctaaaacagatactataccaatatcaaattcgttcactttcaataataaaacagaattatggtacaataatatattatcccctgcaaagggactcaggatgacaggttctatattatatgaaaaccaaccaaaatcagatttttttccactacaaatccaacttttaaaagatgaaaaactagttgaaacattagttccatatgtgcttactccctcccaacacaaagcagatgaaccaattgattttatagtttgttctgatcaagaatttgatcaaatgattgtttggaaattgattgctctagggttttcggatgatataggtgatcttactttgaactatagtggtgaaatttcatacattccaatggagtattcaaatacagtatttaagaaaatacatgagttaacaactacgcctcaagttttatggaaaaacactttgccaggaaaattaggagaatatgttacgattaatggatttagaaacattatgaataattggagttttaaccctgcatctagtttagaaacgggtggtatagcaatgaaatttttaaagtcagggaaagaaataattactttaaatgatatattatctattcaaaatcctaaaaggaatgaaagatactcaaaaatatataacgataattatatttctcttcatgttccagaaggatttgatgaaattcaagttgctacttttatgaatgcggattcactattaatgtacgaggaattaacaggtaaagtatttttaaatgatgaaggtgttttttcttctcctaatccgtctctgtatattaataaagaatacaatacacctaatacaacaatcctttgggaagctccacttaataatcaaaatcaaattcaaatgggaaatcaagcacatttctttattgaaaatactcctgaaccaacaaaactacagtttcaatttataaaaaatgagcagattatttacagtgtagagaatattatagaggtagagggaaatccaccacaaataactaacgaaattattgtaattcctacaaatgtatcaaatggatttgatactattcaatttacacctatagatccaacatttaatggattaattgttggatctgtggaagttctcagtccttctcaaaatacagtgaatgaaacaaaaatagaacattctttatctttaagtgaaaaatccaaatctattttttatacatcaaaagaattagaacaaattacagcactcacacaaaaattatttatttctgttaaagaggatatattggctgatgatgtaacagattatcagattaatcaagtagctttaaaaatagatggattatctgcagagaattttttagtggaaaaacagcaattagaacgcaaaattcaacaggcaaaacggttaagtcaacgtagaaacttgttgcaatatggaaattttgaaagcactgaaccatggatatttagttcccatgctactattttagactcaaatgatctatttccacagccttttttaactttaacatctaccttaacaccagataaaaatccaacttatgcatatcaacaaattccgaaaaatcgattaaagccatatacacgttatattgtgcgaggatttattgcaaaatctacagaattggatattctattgtcctgtgacagtacaattataaaacaacaattaaatgttccaactgcaaaggtacaacagatttcaattgaaaatgggaattgttgtgcgcaagcaggttgtatatatgcagatggaactgtaactgattctcattggtttacttacacgattgatactggatctctgcaacaaaattcggatgttggcttagaactttgttttaaattgacaacagaaaagggtaacgcacagattgggaatgtggaaattatagaagaacgtttattaacagaaaaagaaaaacaaaagaaacagcaaaaagagaaaaaatgggtgaaacagaaacagataaaaatgagggaaatgagaaaaatattagatataatgcatgaagacatcgcatctttgtatgatatgaagatgaatttaaaattggatgtatcccatcaagatattcaaaatgtgtatattccacatgctaactccctagaaggtgtgtatttgtctatggtaccagatcaaccaggtccttattatgaggagtatcaattactagcctcattaaaacgatatgcaagacgggtatatcgaaatagaaataaaatcagtaatggcaccttccagtacgatttattagattggaaacctaaaggaaatgtagatgttcagattgagaaaaaacattctgttttacagcttttggacagtggagctatggtatctcaattggttcaattaccaattgaaaacgtaaagggggaagaaatttcttatcttttacggattcacgcacaagggaatggaaaagtcacaatcttacatggagaagaggttacagttttaccatttacaaattcagatgaacaagtgcaaatgatcgaatggtatccatctacgaatgaagtacagttagaaatcagctcgaaatctggtaaagtgattgtatccagtatcgaaatattagggttctgttgcaaagtt

SEQ ID NO: 4 - DNA, 1182 bp, Bacillus thuringiensis
gtgttttttttgaccgttcagaaaaaaacaattgatccacaactaaatactactattaattcctttcttaataaatatgttgttataaaaaatgtaagtaatcagaaggtactatcagcaagattcggtaatggatatgttgaagcagggccagaaacagatgatgataggcaaaaatttattatttttcaattagataataatgtatttttaattggtggtaaagaaacaggtaggaaaataacatgtgaccataactcttacgaaacagctattttagcatattcagattatgatttagctcaacttccagataatgcttttgtaaatagtcattggatactaaaaaatgtaaaagataatatttttaatatgataaataaagaattttatctttatttatcttctcaacctcaatttcctactggttcctttggtatctggggttttactgattcagcaactggatcaactaatgaacaatttgaattccttccacaagaagaaactattaacattccaacagctccttctttagaaaaattagatccattcccaaaatacacaagtttcacagataatttaccagatgaaacaccacatcgattaacaggatggacaaaaattccttatttaatagttaaagataatgaagtaccttccgagtttaaaatagatatggctccttattacgtaataaaaaaatatcaatattggaaaaaaatcgaaactttatcattagcacctggagaaagtcgtagtacttcgtacacatacggtacaacaacaacaacgacaactaatatggaaaaaagaatagacatgacaattaacgaagacggtggtattaaatttaatttaacaaaaattaatttgggaataacaggagacatgaagaaaactattacagataatttagatataagagaatctagtacaacaagagtaatgaactctacaacagaaacagacgatcaaagaaatccatttactacaaaaccactggtttacagtcgatatatactgacaacagaattacaatatatacgtccttctcaaaataaatatgatccagatattttaatcgatagttggacatttacagatcatcaaacaatgaaaatcacttcttttccatcccgtgaagaaatttctgctgaattaaataaactaaaaataaaa

SEQ ID NO: 5 - DNA, 1062 bp, Bacillus thuringiensis
gtgacaaacccaattcaaccgaaaaaatacatcaatttacaagacacattaaaacataaattgatccaaattcacgatagttccggtaagacactgactgtaaatagtacagaaacatatggatttaacaacctttatttgtatgatggtccacttaatagcgatcataattggatcgcatatcctttaggagaaggaatttatatgtttgttcatatccttactggaaaaattttaacacatccagacatatatttacaatctaaagctatggattatattggtgatacaacacaactatggacattagaaacagttaaagataataaccatttttactatatcagaaatttctattgcggcagtaatgtcgccctaaagagagacactgattttattatgtggtctattacagcaacagatgatatcgatatttctgatacatttccaacattagaaacgttagactcatatcctcaatatacaaatatagatgataatttaccatctactacaccagatcgattaatttcgtttacattactcccagctcctacagtaaaagacaatcaactcactacaaaacaaaaggtacaaataacaccttattatctaatggaaaaacatcaatattggacgaaattacaagatttttccatagcgccaggagcagaattaactaaacaatacacctatggtatggacactaaccaagtaaatgaaatgacaaaaacaacaggtataacaataaatacagatttcggagtaaatttttcacctggtggtattttggaggcaaatggaagttataaaaaacaaattacaaatgatttaaaattacatgaatctcaaactacagatgtagcagaaactacaacaaaaacatctaaatttgataattcaaacaacacatatactatacactatgccaaatatattttgacaacaagattagttttaaaacaattcaattcaaacaattcaaatataacaataggagattggtcattttctgatccaaatacaattcaaacaacatccttgatacccgatatgctaaaa

SEQ ID NO: 6 - DNA, 1200 bp, Bacillus thuringiensis
gtgcgtaatgtattattttatctatatttgttttataaagaacagaggtgtatacaagtgaataatcaacaaacatcgttagatttaaatgataataatatttttgaaaataatattattaccatcaaaaattataaaacaaatcaggtaattgggtatacttctttacaggatatgattccattagaaccccaagcagatactgataagcaacaatttcttttttttcgtttagatggtgggaaatatttgattacacataccttttcaggtgatgtaatacagggagtaagaggggggcttctaccgccacattataaaaaagagtgggtgactgcagatatttttgtgtatcatgggaatgtagatcctgaaatacgattaagtccgcattggattataaaaaatactgatattccaaatacgtaccaactattaaatacacagtgggggctatatttagttccatatgatcaagggtatggttcgaattatttgggagcaattataaaaggcaatgatgaccctcatacatattggacatttcaatcgattgcaactttacaaccaatcatacgacctaaattagaacgattacatgcctttcctcaatataaacaagtgaatgaaaagttaacctttgaaacagcacatcaattaatcgggtggacattactcccttatgtttttgtgaaagatcatcaattagaaaataaaaaacggattaatctttctccgtattatatattagaaaagtatcaatattggaaatgtattgaacatatatcattgggcccaggagaaacaaaaactagttcttatacgtatggtacaacttctattatacaacaaacattggaagctcatctcggtatcattataagtcaagatggcggtcttctttttaagaacaatcgattaactccacatagaggaataacatttgatatcaaaaagaaaattatgaaggatttacatatacatgaagcaataacagatattccaatgaaatcgattacgacggaatatgagcataaaaatccatttcaaacaaaattgttttcttatatgaaatatatattggcaacaaagtttgttctgaaacgtgtatctcaaaatgaacatgatcctaatatagaagtgaacgagtggacatttacagatggaaatacgattaaaattacatcgtatccacctttt

SEQ ID NO: 7 - DNA, 1098 bp, Bacillus thuringiensis
atgatattggatattcttaaaaaaaccaaatatttagattttttaaaaaaaataaaaaatattttttttaaaattcgaaacaatagaggggaagttatgataggacttggtaacaatgagcgtgtgtcttataaaaaaaattctttatgcggaaatgataattggattatatatcctttagataatggaaaatatgtaattgctaatctattatatggaggtgttttagatgttcaatatagaaatgaaaatttgatcgtatatatgaataaatatatgtcgcttccacaacaacattggtcattagaaacagtggatacacatctagcttattataaaataagaaatctagatgtgggaatgataattggaaaacacatatatgatgatacaatctatgctaactatacagatatagatgatgaaaattatcattggacttttgaagaagctggagttattcatctacctataaaacctcgtttagaacaagtagatacattccctcaatatgcaaatcaaaataatgatttacccattaaaacacagcatcgattaataggttggactttaatcccatctattatggtacaagagactgttcctctaatacagccactacaagaattaccttactacattttagaaaaatatcaatattggatgaaattatatgatattgcattactaccaaaagaaaaaaggacaataacttatacatatggtataacagaaaccatgcaaaatagtttaaccgaacaaataggtattacaattcacacagatagcggcgttagttttttattagatcgtcccggaaaaatttatcctataaaaaaacaaattataagagatttaaaaataagtgaatcacaaacagaaaaaaaaatgatagcaaaaacggaagcgattacatatcaaaatccatttgtctctgattttttatattgtgcaaaatatatacttacaacagaattaattcttaaatatattgtgcgaagcaacggaaatccgaatgtagagataaataaatgtatttatacagaccctcaaacaattcaaactacaatctattcaaaaagtgaaaagattgaaata

SEQ ID NO: 8 - DNA, 3858 bp, Bacillus thuringiensis
atgagatgtgacacatacaaattgataggaggacaattcatgaatcaatactatggaaataatgaaatggaagttctcgatctaaaaatgggtcgttcaatgtatccctatgcacagaattcaaggtctgaattacaatcaatggattacaaagagtggctgcatatgtgtgaaagaaatgatggcttatatccaggaactttagcatcaacaaaagatatcattactactagcttagatattgtgggcacgattttgggattcatccctatagtaggtggacctatatcagctggagtttccatactgagttctgtaattggattactgtggccagaaccaacaccagaagagccacaaatagatcctcaagcaatatggattcaatttatggaaaaagttgaagtactaattgatcaagaaattgcgaaagaagcatataatgctgcaattggaagattgacaggcttaaaaagagctttaaatttgtaccaagtcgcatttgagctctgggtgcaagatccaactgatccagaattaaaagagactttacgaattgaattcttaaatgcacgctctgaaatggtatctacaattgaaacatttagatatacaggccaagagataaatctactcacagtgtttgcacaagctgcggatcttcacttgctactattaagagaaggaattatgtatggagtacagtggggatttgacgaaagaaccgtggaatcattttattctaactctcaaggtgaagggctaaaggatttacttcctcaatataccgattattgtacctattggtataatgaaggtttacaaatcacctatactctgaaaccagatttatcagatacggaaagatatccatgggctacaggtaaacctgactggaaccagagagttcttgaagaattagaaggttggaatctatttaacgattggcgaagagatgtaacgattatggcattagatttagttgccttatggcctacttatgacctaggttattacaataatttagagtatggtgtaacaactgaactcacacgtccggtgtattcaagagcatctggaacaagctggggtagcatattgacaagggaccaatatgaacaaggtatcgtccgttcaccacatttagtaacatggttaaactccgttgatttccatttaaatcctggtccgttcaatgcaagtaacagctataaacattataccggtcttaaaatgaaatattattactccggcctagattatacaatctatgaatctccattaataggagctacgtcttatagtaagaaaacaattaatgtggaagctaaatataataacgacatgttccaagcagatgttaaacatgatgatgcagtatatacaatggatttctttaaaaataacgggaatattgaaaaaattggatatccacgggacccaaattattctacattgtcatggccacctgagacgaatatttccaattacgaccatcaaatgacatggataagtggaccagcagtaaataatactattccggcttttggtatagaatgggttcataatagttcctctccttttaattatatagcagaaagtacgatagaaaatcctatcattactcaaatgccagcagtaaaagcagaaactttaaacggaaatgcaagcgtaataaaaggtcctggtagcacagggggcgatttggtatcggtatctccgggggcatctgttgttattcgtttgactggaacaacgcaaccggcatatcaggtacgacttcgttatgtaagtcaaggtgcagggcaactatggatgtctagagacttttaccaagatggaggttggggaaataactatgcaactccctttgatgttcctgcaacaacgtcggatgaatcattaacatacaattcttttgattatgtagtggcacctgggcaaataacgtatccctctagtacagattggagaatgacattctataatagtggaaaaacaattatcattatggacaaaatcgaattcattccaatacaagaaaatgtagcggagtatgaagcacaacaaaacttagaaaaagcttggaaagcagtgaacgccttgtttaccaatgatacgaaaaatgccttacgattagacatcacagattatgatgtggatcaagcggcaaacaaagtagattgtatgtcggatgatatattcacaaaagaaaaaatgatcttactggaccaagtaaaacaagccaaacgcctaagtcaggcaagaaatttattgaatgttggtgattttgaatcaccagattggtcagatgaaaatggatggaaagtaagtaataatgtcacagttcaatcggattacccgatatctagaggccgttatctcaatatgccaggcgcaagggttatcgaatttagtgatacactttatccaacatatgcatatcaaaaaatagatgaatcgcagttaaaaccatacactcgttatttggtaagaggatttgtggaaagtagtaaaaaattagagttattggtgacacggtatggaaaagacatctatacagaaatgaacgtgccatcctaccaagtaatcaatagtcagggagttaggatgctaaatagctgtggtacgaagcaagtatcaagttataccattccaccaactatgccgagtgatccatgtcaaaatgtatatgccacaaatacatccagcttgatgataccatctaccaatggattgtgtgaagataagcaacatttcttattccacgttgatgtaggggaacttgatatgcgagcgaatccaggaatagagttcgggcttaagctttcctccccagaaggtatggctaaattagacaatttagaagtcatcgaagcaaatccattaaccggagaagcgctagctcgtgtcaaaaaacgggaacagaaatggagaaaagagatgaaacaaaaatgtgcactgacagaaaaagcggtgacgtcagctacacaagcagtggattccctattcacaaatacccaaaaagttaaactgaaatcaacaacaaatatgcaaagtattgaaaacgcagaagcaaaagtggatgccattccatatattcatcatcctgaatttgaagatttatcaggtatgaacactatgattttccaacaattacagtctactattatgaccgctatgaatttatatggtagacgaaatgtgatacgtaatggtgattttagtggaggactctcaaattggtcggtaacagatggggtagacgtagaagtaaaagatggtaaattccctgtgctcgtcatttcacaatgggatgcgaatgtatcccaagacgtgtgtgtacaaccagagcatggatatgttctacgtgtaacagcaagaaaagaaggagctggaaaaggatacgtaacaatcagcgattgtacggaagaaaatacagaaactatcacgtttacatccaatgaaaggttcatgactgagaggtcgcctgtaacagtaccaacatccgctgtatgtgatattacagatagctatggaactgggacatctccatacaatcaaaacacaatgggaaatggttacgcagaaagccttgatcgtatctcatgttcctgcggtaatggaagcgagccgtgtacttgtggtagtaacatgcgcaacaatttgtcaggaaggaatggaacaaaatcctatacatctacacagcgtatcccaaatcgagatgcatctcttccttccgcgtatataacaaaaacgattgaaatgttccccgaaacaaatcgtattcgaatcgaaataggggaaacacaaggtaccttcctagtagaaagtattgaattagtttgtatggaagag

SEQ ID NO: 9 - DNA, 2751 bp, Bacillus thuringiensis
atgatttttgtgattcctaatcgcgatcagttttttaaaataacagggaaacaaagtggtaaggtaatgagtgtagatgagcaaagtacgtccaacaacgcgcatatagatcagtatgattgggtgtatcagaataaccaaaaatggctttttattcctcttaataataattattatgcgattgtcaatgaaaatagtggtctggtaatgagtgtagatcaacaaagcacagccaacaacgcgcttatagatcagtatgaatggcatggagatgaaagccaacagtggtttctaaaggatttagaaaatggttacaatggcattcaggcccgacatagtggtaagttcgcgagtgtagatcaacaaagtacagccaacaacgcgtatatagatcagtatccgtgggtggatcagaataaccaaatgtggagtctcgaaactgttgaaagtttcaccctccctgctattatgacgtatcctttagccccccctcctcaatatagttctatgggtgaaacactaccagatcacacggagagtctcccaaccaactatacattagcgccatgtattgcggttgaggatccttattataataatcaacaaaaaatacaaacgggtaacgagtattacttatacgtaaggaaacaatattggaagaaagtcgcttcacacacgcttgctccgggtgaatcatatggatataagcagatatcgggtatgacgacgacagatcaaacaacagtgacaaaaacagtcagtcattcgtttggggcagacgtaggtctgaagtttagaaaagatagtgtaagtgctggtttgtcttatcaatattcagaggaactatcggtacaggagagtcgttcagagacagaattgagtgtagtagaggaagcatttaccctcgaaaatcctaataattatcagatatcatggactaaatatatattagtttctgaatatagtgtacaacgtgcagatggcacactcgtcaacgaaccatggacagtgacggattaccataatacctattcaagtttctatcctttgggttctgacattattgaacagcgagtgtccgttggaatcatagatgcccaacaagctgtatacaatttatttgctgatgcccaacattcaagattaaaaatagacacaacagattatatgattgaccagaccgcattccaagtggaacaattatcagatgaaacatatgcatatgaaaaaatgatgttattcaatttggtacgttgcgcgaaacagttaagtgtaaaacgaaatcttcttcattatggggattttgaatctccaaactggcagaatcaagaagatggttggcaagcaagttctaatgttaccgttttatcggataatccggtgttcaaaggacgttatgccaatatgccaggagcgaaaaatacagcctcaacgtatttatatcaaaaagtggatgaatcgaaattaaaaccatatacacgatatttggtacgaggatttgtgggaagtagtaaagagttagaactgtttgtgacacgatatggaaaagaagttcatcgtaaaatgaatattccgatgaacacatgcagctgcagtatggggcaagtagctgattatacgatgtcaaatgatccatgtcagctatatccatccggtatgacgttgtcatctacggagggattatgtgaagacaaacaacatttcgttttccagatcgatgtaggtgaaatctatcagagagcggacctaggtataggggttggtttcaaaatttcttcttcagacggtatggcccagttagataatatagaagtgatagaagcgaatccattaacgggtgaagccttagcacgcgtgaaaaaacgagaacaaaaatggaaaagagaactagaacaaaaatgtgcactgacagaaaaaacggtctcatcggcaacacaagcagtcgattccctattcacgaatgcacaaaaaaatagattgaaagcaacgacaacgatacaggatattctcggggctgaggcaaaaataaaggcaatcccatatgtatataattcatattttgaagaggtaccaggtatgaattacacgattttccaagcattacagtctgatgtttataatgcatctagtttgtatagaatccggaatttgatccgaaatggtgattttagtagcggcctttcgaattggcatgcgacagcgggtgcggacgtacaagaacgagacggtaaatcgcatgtgttagtcctttcacaatgggatgcgactgtatcacaagaggtatgtgtgcaaccagagcgcgggtatgtcttacgtgtgactgcgagaaaaggagggtctggcaaaggatatgtcactcttaccgattgtacggcagacaatacagaaactgtgacgtttagatcggatgacatggcttcaactccgcgaccatctgtaccgcagcgtccgattgaaccagctatatgtgatataccgcgttataatgaaagcttcggaatcgtcccagagatgaatccggtgatgaatgagcaaccagagagttacggaacaacatcttgttcttgtgggtgtggtaataggattcagacgccatccacaccacgtatgccaaacgtaactggttcttcgcctggttacctcacaaaaacaattgaaatgttcccagaaaccaatcgcctgcgaatcgagattggtgaaacagagggaacattcctagtagaaagcatagaattaatttgtatggaagac

SEQ ID NO: 10 - DNA, 3711 bp, Bacillus thuringiensis
atgaatcaaaattacaataacaatgaatatgaaatcagggatactgataccatgtgctatcaatcaaggtatcctcttgcaaatgcaccaggatcggaattgcaacaaatgaattacaaagattggatggatagttgtacacttgaggaacaggttgaactattcagagatacctcaactacagttagggatgcactaactacaacggctggtatcatagccgctttactaagcgtttcgaatccggtgtctgcggccgcagctggaattatcgctctacttattccacaactttggccgagtggttcagacgaagtaacttgggaaaaattcatggccgcatcagaaatcttaattcaaaaacaaattacagaggctgtacgtaataaagctctttcggaattagagggtatgtatagaactatacgtctttatgaactagcggcagaagattggaaccgaaataagaatgatccagaggcaaaagaaagaataagaactcaatttcgcgctacgaatacggtaattgagttcgcaatgcccgcatttagagtagcggggtttgaggtaccactgttaaatgtatatgcgcaagctgctaaccttcaattaacgttattacgagatgctgtgaaatttgggtatgattggggactacctcaggatgaagttgacgatatatatagtgaacaactaataccaagaatctcagaacacacagaccattgtgttaggtattttaatataggagtagaggaagcaaaaaaattaaaagcaaatttagatgattatgctcgttacccttgggcacagtatataaatcacgggaagatacaaggaattgaaaattggaatctatttaatgattatcgaagaaatatgacaatactggtgttagatgttgtcgcactatggccaacatatgatccaaaacgatacagtattgtaacgaaatcagaactaacacgcgaattgtatacaagtgtacgtggcgcattttacggttcaactggagattacaatcaagatttggaagaaatcgagaggaatattatctctccaccaggcctagtcctttggccaatagagtctattgtgtatacacaaaatcatacttattatcctatggcaggtctacaaacgagatcctattacagtaactcctatacttaccaagacagtccagtgattggagtaacaggaacccctaatcgtattaattttgatagagctgatcctttcattttgactgtaacaataattggttttggtcaattgggaacatctcttggcatatatacaatggattttgtgaaggtgagcggtagccataggaaagttgggaatatagaagtaggaactgatggttatattgatataccggatcgtattcctgtaggcgataatcctcctaatacactctcatggatgagcgctggtgctactactcttggtataacaaccttcttgcaatatgtgggttatgcttggatgcatcctagcgtagatttttccaataggatatcacttgataagattacccaaattccagcagttaagggacgttcgttgacaggaactgccaaagtgattaaaggacctggatctacaggaggagacttagtcgctttgtctgcttatgatcttcttagtatagcagtgtctttgccggcaaatgatacagtattttataagttaaggattcgttatgcgagtagtcagtttgctagagtacagatgtctttcacaggacctcttgaggatggagaggcgacctttgattttccagctacgtattctggtggtaatctaacatacaatagttttgaatatataactacttttgcaataaactcacaatcagaggagcaatttgttgaaatccagttcgtgaatttcaatgaagtcgattttatcatcgataaacttgaattcattccaattgaagggtctttagaagaaaatgaagcggatcaaggtctagaaaaagcaagaaaggccgtgaaagctttgtttacgaatgatgcgaaaaatgcgctaaaattgaacataacagattatacagtggatcaagctgccaatttggtagaatgtgtatcagaggacttccatgcccaagaaaaaatgatccttctgaatcaagtgaaattcgcgaaaggactgagtcaaacacggaatctactgaaccatggtgattttgaatccccagattggtctggtgaaaatggatggagaaccagtcatcacgtttctgtcagatcggataatccaatctttaaagggcgctatctccacatgccaggtgcgatgagccctcaattctctaacaatatctacccaacatatgtctatcaaaaagtggatgaatcgaaattaaaatcctatacccgttaccttgtacgcgggtttgtgggaaatagtaaggacctagaattattggtcgaacgatatggaaaagatatacacgtggagatggatgtaccaaatgacattccatattccctaccgatgaatgaatgcggtggcgttgatcgatgccgacctgtatcctatcaagctcgctcctctcatgcatgtacatgtagcgataccgctgtaacacatacagattgtcagtgtaaagataagggaaatcgcactttaacgaacatgtatacaaatgtgccaacagatcgtgcggtatataggaatggatcccatgaccacaaatcctgtggatgcaagaacaatgacatgtaccggagcgaaacacatccgcataagtcttgtggatgcaaagacccacatgtcttcacgtatcatattgatacagggtgtgtggatcaagaagaaaaccttggtttgtggttcgcattgaaaattgcgagtgaaaatggtgtcgcaaatattgataacttagaaatcattgaagcacaaccactcacaggggaagcattagtacgtgtgaaaaaacgtgaacagaaatggaaacaagaaatggcaaaaaaacggttagaaacagagaaagctgtacaagcagcgcaaggtgcgattcagaatctgttcataaatgcgcaacaaaaccgtctgaaatttgaaacgttattccatcaaattgtccatgcggagatgctggtacaacagattccctatgtgtatcatccgttcttgagcggggcacttccagcggtaccaggtatgaattttgaaatcgtccaacaactatcagcaacgattgggaatgcccgtgcattatacgaacaacgaaatctcgtacaaaatggtacatttagtttaggtacaggaagttggaacgtgacggaaggcgtaaaggtgcagccacttcaaaatacatctgttcttgttctgtccgaatggattcatgaagcgtcccaacaggtacgtatcgatccaaatcgcgggtatgtgttacgtgtaacagcccgaaaagaaggcgcagggaaaggtactgtgacaatgagtgactgtgcagactatacagagacactgacctttacatcatgtgactttaacacgtctggttcccaaacgatgtcaattagtacattatctggatttgtgacaaagacgctggaaatcttcccagatacagatcgcatccggattgatatcggggaaacagaaggaacatttaaaattgaaagtgtagaactcatttgtatggaacaaatggaaaaccatttatatgatatggcggggaacttagaagaa

SEQ ID NO: 11 - DNA, 1062 bp, Bacillus thuringiensis
gtgatggtaaaacgagatatttctccaagagatcttggaggtaaagaagattccccattcttactttctaaggaggaatggattacgattcaaaaatatacaggtgatggagcatatgtgcctgtaaatgaagctgaaatgcgtaaagctttagcactttcagcctcagacgagatgccagattttaatgaattatattctgtttatacaaatgttaaaaatcactgtcaaaactggacagataacacatatagagaagttcttggagttgcgaatgaaattgtaaattattcaaggagagcaaaagtttactacaaaccattaatcgattatttaccagctattatagatggcgatactgaggctttagaaatgtttaagaaaatttgtgagaggctagcaagggaagcagctgaatttcgtgatcatgccggttcattggcaaccatgattggaacatttgcaactgatacggcaaatgattatcagagtttaaaagtggttaaggataaatatgatgaaaaatatggcgaccatagtgacgaagtaaaacaacttagagcttcggtagagcgattacgggaagacttagaggagtatatggatgagtatgaggactatcaatctcaatcatggttatctctgttacttggtcctatttttggatttgtattaaaaggaattctcgacagtacaaaaggtaaagcattaaaagctcgaattgatgctacaaaacaacaaattgaagaatctgataaaataatacaaagaaatgtttatctgatgtctttacttgataaaactgatacaggcacggataaaatccaagagcaaatggctgctgcgttacctatcatacagaaaattcatggcatttggaattctcttcatagtgatcttgatgaactatctaaaattgttatggaagacattcatgatgatccagaatttgctgatcttggggttgaattggctattatgcagtgggaagctgttggaaaacaagcggatgacttccgagttaatgcagatgttgggtttgttgttgaacaatacacagct

SEQ ID NO: 12 - DNA, 4047 bp, Bacillus thuringiensis
atgtacttaaatgtagtatcgagtgtttaccacactatgagatcgattgccatcatgttgttgtttcagattttaaagtgcagccactgcaagaacatggctgtcacatgctgcaatttacaggaacgattgaatttaaacacattccacatgcataaagcatcaggcagctacctgtattcgttgcatatacaagacaagcgaccacacatacgaaacatacgaggaggtttatacatgaacttaaatgataacaagaatgaatttgaaatcatggataatggtaacatggcctatcagccaaggtatcctcttgcgaatgccccaggatcagaattgcaagccatgaattacaaagattggatagatatgtacgaaagaagcactaatggtaatatgctcttgcaaaatatgggggctacattaggcgtagccttagctgttacagcattcatactaagcgtatcatttccagtggcatcagcagctgtgggcatagttagcttacttatgccaatgtattggccatcaagttccggcaattcgcaagatgtgtggaaaaattttatggattctgcagaagctctcatggatcaaaaaatcgcatatcaaaaaagacaaagcgctgttctgcaattacaagttgtacagtctcgacttaaggactatcaacaagcagtatgtaacttgaaacgcgatccaaataatgaaaactataaaagtttagtaagagatgcatttgatgatgctgatgattcattgaaagaagttatgatcaactttggtgcagaatcagatgaggtactactgttaaacagttatgctcaagctgcgaatttgcacttgctattgttgcgagatgttgtgaaattcggaagagattggggtatgaaggaacttcaagtcgaacaatattatgataatccgcctaaccgaccaggaaacccagggatggtacaattgttagcaatctatacagaccattgtacacgttggtaccaagaaggcgcacaagtacaatacaatactctagattggaataaattcaatgattaccgtagggatatgactattatggtgttagatatagtatcaatatggccaacgtatgaccctttctattatgaatatcctgcgaaaatacagttaacgcggaaagtgtacacacgagtatttggcgaatatccgaaaaatagaatcgatgaggtagaatggatggtccccacacctaggttgtttttatggctagataagctaaccttctatcgaagaaatgaggaattaggacaatatgctggtattacacagaggttcaaaaccacttttgattcgcagtcacttgactacacccagggaatgcaaacagatttatttgatgtagttgaaattaattcaggacaaattaacaataggttgagtcttaacggtgtgtggaaaacaagtaatgttttaggacagtattcgggtgctgcaacggtacaaacattctctttttatttattgcaatcagaggatccgtataacccaataaccctaggaaacgtttataatacaatttctaatactacttacggacttccttgtagcacaaatacaacaggctgtaccagcaatccttgtgagccgtgtaatctttctacttcccaggaatctgtgtgtgatattcccggtaggatcactcatactttagcaaccgtgaattgtggtggatggtatgaaaatctaagatactttgcttacagttgggcacatattagcgtaactgtaaataatgttataacaccttcaaaaacaattactcagattccagcagtaaaagcctataatacaactggcaacgtaattagcggcacacaaagcacaggaggagacttagtagagttgccagctaatagttccttgcagatgatactgacacaccttccaggtgataaaatatcaggatatcgtatgagaattcgttatgcagctaagcaacctgttaccattttagtagggcactcttctgattttggagaaaaattaagttcttttgaacttccagctacgtattctggtggtagcctaacatataatgcctttggatacaaagaaaccttaacaatcctcagccaacaagtagaatatattggtttcgtaggattccgtagtactaatgccaccgtcatcatcgacaaaatcgaattcatcccaattgaaggatccgtggaagaatatgaagcaaaccaagatgtagaaaaagctagaaaggcagtgaacgccttgtttacgaatgatgcgaaaaatgccctgaaattgaatgtgacggattatgctgtggtccaagctgctaaccttgtagagtgtgtaccagatgaattccatacacaagaaaaaatgatcctactggatcaagttaagtttgcgaagcgtctaagtcaagcacggaacctattaaactatggggattttgaatcgtcagattggtcgggagagaatgggtggagaaccagtcatcatgtccatgtagcatctgataatccaatttttaaaggacactatctccacatgccaggtgcgatgagccctcaattctctaacaatgtctatccaacgtatgcgtatcaaaaagtggatgaatcgaaattaaaatcctatacacgttacctcgtacgcggttttgttggaaatagtaaggacctggaattactggtagaacgatatggaaaagacgtacatgtagaaatggatgtaccaaatgacatccgatacgctttaccaacgaatgaatgtggtagctttgatcgatgcagacctgcctcgtatcaagcaagaactcctcacacatgcacatgtaaagataccacttccatgcatacggattgtcaatgtcaaaacaaagtgaatcgtacttcggcagacatgtataccaatggatcgccaagtcgtgtcatgtatgcagatgaattccattcgcaccaatcctgtggatgtaaaaacaacgacaggtatcagaatggaacacatccacagaagtcttgtggatgcaaagacccgcatgtcttctcgtaccatattgacacaggatgcgtggatcaagaagaaaacttaggtctattctttgctttaaaaattgcgagcgaaaatggtgtcgcaaacattgataacctggaaatcattgaagcacagccgctaacaggggaagcattggctcgtgtaaaaaaacgagaacagaaatggaaacaagaaatggcgcgaaaacgtttacaaacagagaaagctgtacaagcagcgcaaggtgcgattcagaatctgttcacaaacgcgcagcacaatcgtctgaaatttgaaacgctattccctcaaattgtccatgcagagaagctcgtagagcagattccctatgtgcatcacccattcttgagcggggcgctgccaactgtaccaggcatgaattttgaaatcatccaacaactattggcagtgatcggaaatgcccgtgcattatacgagcaacgaaatctcgtgcgtaatggtacattcagctcaggtacaggaagttggaaagtgacagaaggggtaaaagtgcagccattgcaaaacacatctgttctcgttttatcagaatggagtcatgaagcgtcccaacaggtacgtatcgatccaaatcgcgggtatgtgttacgtgtaacagcccgaaaagaaggcgcagggaaaggtactgtgacaatgagtgactgtgcagactatacagagacactgacttttacatcatgtgactttaacacgtctggttcccaaacgatgacaagtggtacattatctggatttgtgacgaagacgctagaaatcttcccagacacagatcgtatccgtattgacaccagtgaaacagaaggtacgtttaaaatagaaagtgtggaactcatttgtatggaacacatggaagaccacatgtatgatatcgccggaaatgtggtggaagagatgcgttacctagattcatctcgttcgatgggtggtacattagatgcgatgtgttatacaaaaattggagagtttggttgt

SEQ ID NO: 13 - DNA, 3801 bp, Bacillus thuringiensis
atgtatcagaattacaattacaattacaaggaatatgaaattcttggtattggtggcagggactatcaaccaaggtatcctcttgcgcaggcacctaatgctgaattgcaacagatgagctacaaagattggatgaatagatgtgcaggtgtagaatcaggagaattatttgatgcagatgctgttaagacaatgctccttattggtacaggtatttcgtgggcaatcctcggcgttgcattcccacctttgtccgtagcagtgggaatattaaacgtaatgatttcatacttgtggccaagtcaggctactgaagatcaattctcatggaagcagatgatgtctgctacggaacagcttattaatcaagcaattaatcctattataaaatcaaaggctattgacgcactcagagatttacattcaagtttacgggactataaccaagcactctgtaatttacaaacaaacctagatagcccggatgttgaaaggtacaaagaagtcgtaagaagggaatttaatgatgctaatgacaaggcaaaatccactatcatcaacttggaatctgatggatttcaaatacaattcttatctagttatgcacaagctgccaatatacacttactcttgttaaaagatgttaaacaatacggagaaatttggggccttacagcacttgaagtagagcaatattttgataatcctcctagcaaaccaggaaacccaggcatgatacagcttatagaaatctatacagattattgtataaattggtataatcgaggtttacagcaacaagccgaaacttactattggaatggattcaatgattttcgtagaacgatgaccatagtggtactagatattgtggcattatggccaacttataatcccatcaattatccaaaaccagtgaaagcacagttaacgaggacagtgtatacgccaacatttggtcagcatatagcttcttcgaaagtgttatttgatgagcttgaattatctctagtcacgcctcctcaactatttacatttctagatgcggtaactttttatcgaagggacgacgaattgacacaatatgctggtataatgcaaactttgagatacacttcgagtttgtcattatttcagacaatccagggacaaagaacagatttagttgataatattcgaatttattcaggggtattagatgaggtttggaaaacggcaagtgttgtgggagaactcgacaatactagtagtatgaatattcaaacattttctttttatttattaagtaatccagagaatccagttactataggacatgtttatagtagtaacaccactgctgctacctatggatttccttgtgtagcgacaaatatatcctgtatcggcgaaccttgtacgccatgtagtatttctcagcctctggaatctatatgtaatattccgaataaggctagccatttattagtatctgtaactgctaacgtacaaaatcatataagattagcctcttacggttggaatcacctaagtgctgatgcgaacaatctgctagatgctgaaaagattacccaaataccagcggtgaaaggagttagaatgctttctaatgttagtgtggtgaagggtcctggtagtacggggggagatttagtaaaaatgtctaacggggacggggtgttctctataagtattacaagctctgctacaaatgaaagagtatccggatatgctataagacttcgttatgcaagtaatgcagatactaattttcaaatctttatggcaacaaagggtcaacctatgattgttagcgaccaaattattccatctacatcttttgataatagtctcacatatcaagcttttgactactacactttgtcagagttcgaactaaagacattaccagaagttaaacaagacacttttttcgacttttttaagcgtggcgcgggagatatccttattgataaaatcgaattcattccgattgaagggtctttagaagaatataaagcgaatcaggctttagaaaaagcaagaaaggccgtgaataccttgtttacgagtgatgcgaaaactgtcttgaaattgaatgtgacggattatgcagtagatcaagctgccaatcttgtggagtgtgtatcagaggaatttcatgcacaagaaaaaatgatcctactggatcaagtcaaagtcgcgaaacgtctgagtcaaacacgaaatctattaaactatggagattttgaatccccagattggtcgggagagaatggatggaaaacaaatcatcatgttcatgttgcgtcagataatcccatctttaaagggcgctatctccacatgccaggtgtgacaaactcacagttctctaacaatgtctaccccacgtatgcatatcaaaaagtggatgaatcaaaattaaaatcctatactcggtacctggtacgtgggtttgtcggcaatagtaaggacctagaattactggtagaacgatatggaaaagatgtccatgtggaaatggatgtaccaaatgacatccggtactctttaccaatgaatgaatgtggtggctttgatcgatgcaaacctgaattgtatcaagggagacctcttcacacatgcacatgtaaggataccacttccgtgcatacagactgtcaatatcagaacaaagtgaatcgtacttccgttgatgtgtataccaatggatcgccaagtcgtaacatgtatgcggacggattccattctcacaaatcttgcggatgcaagaacaatgacatgtatccgaatggaaccgattcgcataagtcttgtagatgcaaagacccacatgtcttcacgtatcatattgatacagggtgtgtggatcaagaagaaaaccttggtttgtggttcgcattgaaaattgcgagtgaaaatggtgtcgcaaatattgataacttagaaatcattgaagcacaaccactcacaggggaagcattagcacgtgtgaaaaaacgcgaacagaaatggaaaaaagaagtagcaaaaaaacggttagaaaccaagagagctgtacaagcagcgcaaggtgcgattcagctcctcttcacaaacgcgcagtacaatcgtttacaatttgaaacgttgttcccgcaaattgtccgtgcagagaagctcgtagaacagatcccatatgtgtaccatccattcttgagtgaggcactgctagccgtaccaggtatgaattttgatattgtacaacaactctctgccttggttgatagagcacgaggattatatgacctacgaaatctcgtacaaaacggtacattcagctccggtacaggaagctggcatgtgtcagaaggtgtaacgacacatccagaaggaaatacatccgtactcgtcctatcggaatggaatcatgaagcgtctcagcaattacgtatcgatccagatcgcgggtatgtgttacgtgtaacagcccgaaaagagggggctggaaaaggtacggtgacgatgaatgattgtgcagactatacagaaacactgacctttacatcttgtgattacaatacgatcggtacccaaacgatgccaggtagtacgttatcgggatttgtgacaaagacgctggaaatcttcctagatacagatcgcatccggattgctattggtgaaacagaaggaacatttaaaattgaaagtgtagaactcatttgtatggaacaaatggaaaaccatttatacgaaatggcagggaatttagaagaagagatgcaagctctagagggttctgttgcaaagtttgaa

SEQ ID NO: 14 - DNA, 840 bp, Bacillus thuringiensis
atggaggttattaatatggcaatcttagatatatgggcagaagtagataagtttgcaacaaattactgtaaggggcgtggattaacttattctggaaaaaagggtcccgttcctcaatatccattaattatgacaaatttccaatcgagtcttcctgatgatagagtcctcactccaccagaacatgtagctactcttccaaaaacatatgataatattacaagccggccacaaacaacaacactttcattttctgaagaactaaccgagtctacttctacaacaacaacagaaggtgtttcaattggcactgaattatcgtccactcaaacattcaagataaaatttgtagaagttggacttacacaaacagtaagttcagaatataccacaacttcttcaaaaacattgactacagagaaaaaaaggattgtgactagtgcggaacaaattacggttccaccttatacacgtattaaggcagttcttgtgattgaaaatggcatttatgacttaattacagatgtaacatgtgatctaaatggaatgatttattttgaggccacaaacgggactagctttttaagtactatttatgaagtacttaaaggaaataatacacctgattttacattttcatttgaagatccagaagatcctacttgtcacttcaatggatctggaaaaattaaagggaattctggattaaatagttatgttcgtgttgagcaaagtcctttagaaggatattcaggacaatatcgtcaatatatactacctggtcaggatttaaccacagacattattacgtctgagaattttgggattcctatatttaat

SEQ ID NO: 15 - DNA, 4062 bp, Bacillus thuringiensis
atgggaggattgttgatgaatcaatatgaaattttggataatggtgacatgggctatcagtcaagataccctcttgctcaggctccaggttctgaattccagcaaatgaattacaaagattggctgaataggtgtgcagttggggaatccggagaattatttggagattcaaatgctctgagggacgggaccgttacaagtgtaactattttatcagttatcctcagtgtatcatttcctgttgcttcagcagcagtaggcattattgctgtcgtgttgccatttttgtggccggagcaggccggaactcctggaacctctgaagcgcagtttacgtgggaacaattgatggatgctgtggaagaactcattaataatgctattgctacggaagcaaaaagagatgctattgatgcgctcgaaaatttacagacaagcgtaaatgattattacagagcagtctgtaatctcaaaaccgacccagatatgaatagttataaggaaagggtacgaataacctttattgctgttgatcaaaaggcacgagatactattaaccgcctgaacgataatcctcccacacatgcagtccaattcttacctagttacgcacaagctgctaatttacacttacttttgttacgagatgttgttcaatatggagagagctggggatttacagctgttgaagtccaacaatatttctctaacacgacgggtgtaggcaacccaggtatgcttcaactattagcgatatatacagattattgtgtacggtggtataatacaggtttacggcaacaatacgatactggtgactggaataaattcaataacttccgtagagatatgaccataatggtactagacattgtatcgttatggcagacatataatccaaaactttatgcagttcccacgaaatcacaacttacccggacggtgtatacacccttgttaggatttacagatccttatggtacaggatttacaccgattcaagtaatagaagcagctgtaactgatgttccacgtctatttacatggctgcgtgagctgagtatcgataaaaatattgaccccttccccggccgtcccatagaaccaagtcaacctggatactttacaggtcgtagaatagtcttccaaaacaccttggatagtactctatttgaaggaggataccgtgggaatccgggagagctaagagagaccctgacgattccctcaccggaacttggcgatgacgtgtggcggattaccactaaagatactatactctcagctttagaagggagagatattaagtcatggtcattttctttgactaaatcaccggatcaaagtttatacggtgggacttactcaaccaacagtgtacttactggattaccttgtaataatagtgtttctggtccttgtaatccttgtaatccttgtagaattgaaagtcctaatatgaatgttccttgcaatgacaaaaatctttatagtcatcgtttttcatatatgggagccggaacaatatacgtaattggaaaaaactatttagcgtattttagctacggctggacacacgtcagcgcagatgcaaacaatctgatagaccctgaaaagattacccaaattccagctgtgaagggatcctccatttggaacggtgctacagtaatcaaagggcctggtagcacaggaggcgatttagtccaattacctattagaacttcaatgcatctagaggtgacacttcctgcatttgatgaagatatagtagcatcctattcggtaagaattcgttatgcgagtagccagtctactaacctcggcgtgcagttcgaaggggaaattgagcaaggttcgcgattagttgaacttccagctacgtattctggtggtgatctaacatataatacctttggatatcaatttgctttggggataacctcacattcagagagccaacgtggtactataatactcaaccatgtagggcccagcggacccaatatcatcatcgacaaaatcgaatttgttccacagaaagtatcagtgacagaatatgaagcgaatcagaatgtagaaaaagcaaggaagacagtgaatgccttatttacgaatgatgcgaaaaataccttgagattacatgtcaccgattacttggtggatcaggcggcgaatcttgtagaatgtatatctgatgaagtccacccaaaagaaaaaatgtgcttgctggatcaagtgaaagtagcaaaacgacttagtcaagcacgcaatttattacaccatggtgattttgaatcacctgattggtctagagagaatggatggaaaacaagtaatcatgtgtccgtcacatctggtaatccaatctttaaaggtcgttatctccacatgccaggtgcggagaatccacagtttagtgaccaggtatttccaacgtatatgtatcaaaagatagatgaatcgaagttaaaaccatatacacgctatatggtacgagggtttgttgggaatagtaaagatttagaagtgttcatcacaagatacgataaggaagtacacaagagcatgaatgtaccaaatgatatcccgccaatgaatccgtgtaccggggaatatcaattgggagaaggaccgatgctcacaaattatacgataccacaagacatgtcctgtgatccatgtgaggttggaacagtgatgaaggtccaacagacctttgtaaaatgtgaagatccacatgtcttttcgtttcacattgatacgggtgagctggatatggagcgaaatctgggtatttgggttgggtttaaaattggaacgacagatggtatggcaacagtagataacttagaagtgatagaagcgaatccgttaacaggagaagcattgtcacgtgtgaaaaaacgtgaacaaaaatggaaacaaaagtggacagagaaacggacgaagattgaaacggccgtgcaaacagctcaaggtgccatacaagcgttatttacaaatgcaaatcaaaatcgcttgaaaccggatatcaacctaaacgatatcttacaagcggagaacttggtacaaagaattccatatgtatacaatgaattcttacaaggggccttaccacccgtaccaggtgaaacgtatgacatcttcttacaactttccagcgcagttgcgagcgcacgatcgttatatgaacagcggaatgtgctgaacaatggggatttctcagcgggactgtcgggctggaatgccacagatggtgcggatgtacaacagatcgggagtgcatctgtgttggtgatttcagattggagtgcaagcctttcccaacacgtgtgcgtgaaacctgaacatagctatcttttacgtgtaaccgcaaaaaaagaaggctctggagaaggatacgtgacaatcagtgatggaacggaagaaaatacagaaacattgaagtttacagtgggcgaagaggcaacaagttcgccatcgtctgatattcgttccaatcttcgtgaacgctatcaggagcggaatatggtgaatgcttctgaagaagcatatggaacaaatggatatgcgagtaatccgatggcaaactacccatcagacaatgatagagcgaatacccactctagaaataattataggacttacccatcagaaagttttggaattacgccatacagcgatgaaaatccgatgacggattatccaaccaacaagtatgagatgaatacttatccaggtagcacaaacatgacaaatccgaatggaggatgcagctgtggatgtagcacaaacacatatgctggtgaaaatatgatgatgaatgcttcatccaatgcgaatggggcaggttacggatgtggttgtcgcacctatataaacaacagtacagattcctatgcgtctcctatgaccgcacgaaacggttcttctctctcaggttatgtaacaaaaacagtggaaatcttcccggaaacgaatcgtgtctgcatagaaatcggcgaaacatctggaacatttaaggtggaaagtatagaactcattcgaatggattgcgaa

SEQ ID NO: 16 - DNA, 1791 bp, Bacillus thuringiensis
atgaaaccaaataaccagaataatcatcaaaccttattgagcaatgtgaccgttgataaaccttttgcagatgcactaaaaaatgaaacaactatggaattgaaaaatagtaatcatgaagattgtttgaaaatgtctgaacatgaaagtatagagccgtttgttagtgcatcaacaattcaaacgggaattggtattgctggtaaaatcctcggtagcctaggcgttccttttgctgggcaagtagctagcctctatagttttatcctgggtgagctttggcctaaagggaaaagccaatgggaaatctttatggaacatgtagaagagcttgttgctcaaaaaatatcgacttacgcaagaaacaaagcacttgcagatttaaaaggattaggagatgctctagctgtctaccatgaatctcttgaaagttggattgaaaatcgcaataacacaagagctagaagtgttgttaaaaaccaatatatcgccttagaacttatgttcgttcagaatcttccttcttttgcagtgtctggggaagaggtgccgttattaccaatctatgcccaagctgcaaatttacacttgttactattaagagatgcgtctacttttggaaaagagtggggattatcaacttcagaaatttcaacattttataaccgtcaatccaatcgaacgatagaatattctgactactgctcaaaatggtataatacgggactaaatcgcttgagagggacaaatgctgaaagttgggtacggtataatcaattccgtagagatatgactttaatggtactagatctagtagcactattcccaagctatgatacacatatgtatccaattaaaactagtgcccaacttacacgagaagtatatacagatccaaacggtgttgtagcaggacccaataatagttggtttaaaaatggggcttcgttttccgctatagaaaacgcaattattcgaaagcctcacctatatgattttataacaaaccttacaatttacacgagaataagtcgagcaaaccctagttatatgaatttgtgggcaggacatagaattacttttaatagaataggctctagtaatagtagtgaattggtgtatggagctattactaacccagttagcactagtagcttatcatttgtcaatgaggatatttaccgaactacatcattagctggcgcacttggcacccttagcggactaatttatggtttaactaaagctgattttgatacaagatttcgtaaccatactaatatagcaagcgggaaaacttattttccgggacattctggcattggaactcaagtgagaaattcagaaacagaattaccaccagaaacgacagaacagccaagttatagagcctttagtcatctactaagccatatatcaatgtctccaacgactgcagcaacacctccagtgtattcttggacacaccagagtgcagatcgtacgaatacaattaattcagatagtattacacaaatcccattagtaaaggctaataaccttcatccaggcgctattgtcgtcaagggcccaggttttacaggaggtgacatactccgaagaactagcacgggtacatttgtggatttaccagttaatcttattaattggcaattatcacaaagatatcgcgtaagaattcgttatgcttctactacggatttacaatttcatacgtcaattaacgggagagctattaatcaggggaatttttcagcaactatgaatagaggagatgccttagaacctgtc

SEQ ID NO: 17 - DNA, 3276 bp, Bacillus thuringiensis
atgaatttaaatgagaatgaatctataatcaagaaacatggacgtatcaacaatcaaactgaacatggtttagaaaaagtacggaaggccgtggactccttgtttacggatgaagaaagaaattccttaaaattaacagtcacagattataatgtggatcagattgcgaatctagtcgaatgtatatctaacgaaatcttgccaagagaaaaaacaatcctactcgatcgaatcagattagcgaaacgactcagttacgctcgaaatctattaagtaatgggaactttgaatccccaaacgggcccagattgaaggggtggagaacaagctcttatgtaaaagttttaactgataatcctatttttaaaggtcggtatcttcatatgccaggtgcaagaaaatttgaatcgggcaatgtatatccatcttatgtgtatcaaaaagtagatgaatctaaattaaaaccgtatacccgttacttagtgagagggtttgtgggcagcagtaaaaatctcaaactgttggtacagcgatatggaagcgaaatacaagtcgagatggatgtaccaaatgatatccgctatgatatgttaacaagtacatttggtggatgggagggggagaggcaacaatcatatcaaatcatccctacacacacatgtacttgtaaagataaaatatcaataaatacaatggggcagcaaatgaacaaatcatgtggatgcaaaaatccacatgtattttcatatcacatcgatacaggaagccttgatttcactgaaaaccttggactatggtttgtattaaaaattatgagcacagatggtgaagcaaatattaataatttagaaatcatcgaagtggagccattaacaggaacagctttagcttatgtgaaaaagcgtgaacatagatggaatgtaaatatgacgcaaaaacgtttacaagcagatgaagcaatacaagtagcacaagaagcggtccgcaatttattcacaaacccacaagaaaatcaattaaaccttgatagcaccttcctcaatctagtgattgcagctgatttggtcgataggattccgtatgtgtatgattcattcttaattggggcactaccaagtatgaattttgaaattgtccaaaaactctcccaattgattgatagagcgtggagattatatgctcgacggaactttgtacgaaatggtacattcaaatcttacacaaacgactggcatgtaacagagggggtagaagtgaaaaaaacgtacaatacatctgtgcttgtcctatctaattggagtcatgaagcctctcagcagttgcaggtagctcccaatcgtggatatttgttgcgtgtaacagctcgaaaagaagatgctggaagagggaccgtgacgataagtgatagtgcggaaattatagaaatgctcacctttacatcttgtgatgacgaaacggtcagtgaagaaggcgcattctgggggtttgtaacacaaacgcaggaattcttcccagatacaagtcaagttcaaattgatatcggagaaacagaaggtatgttcgaagtagcaagtgtggaactcatttgtatggaacagatggacaccccattatacaatattgcgtgtcaaaaagatattgatattccttcaaattcagtaggatgcgcacagaaacaagcaataaattttcacggccctctattagatcgtttaagtacagatgggagaacttactgggaatatctcacaagatattctcctgttatgtatcaagctataaataaaagctatagcaatggaaaaacggatttaattacaaaatttaatgcagatgggaattggaatatggctgaccaatgggaatcaataggagaatttcctcaaattccatatgtgtatgcttctgttcaagaaacgaagacacacctctttttaggatattatttttatcatgcacgtgatgagggtttctttcccgcagagggacacgaaaatgacttagaaggaatgatgatagcagttcgaaaagatgggaattatggtgttcctgtggctatggaaacaatttatcattctgatttcctacggtatcgattaaaggatcctaatgtgcagccaggatatagtaaaattgaaaatacttcagttcgtttctctgaagtaacccatccggaagtttttataagtgctaatggggatttgttgggcgagttcggacatagtgtgagtgcttttactggtaacgaaagtgttgaaaataatgggattgtctataaatttggagagcctccatctgaagaacctactcaattttcaccagagtggcaacatacttataattatggaatcttgccaatagatgaattatgggagaaaaaatatagctatgacaatacaccgtttcaatcttttggtgtttttccaaataccgcgcccggaggaaccggaaatgcaaacgctccttggaactggtctgatgaagatcaagatgggaccctaggaaagggaatctttttcacagatccagcttatttatttgatattgattttaatggattagggacattctctcatgaatatgtgtacaatccctattggacacataaagtgatactcaagtctgtcactcctaaggtttataaagaccctagcaataatctacctgatatatatattagtatggaacaatatccattgaaaggcatgagatatataagtgaaagagtgtggatgaaatcggatgcagctttacttgtaccgcacaccgtcaaatttggtggtgaccaaaaaaccgcaaatactactttttcagagcctacgaatacactttatatcgcagtttctaatattaatcctctattgtggttggaagtaaaggattatgatgcatcagatgcggatgattatatgggatctattgtattacctttagatacaggtaatattgcaggaaaagctgatttaaaagaagctataattgattatgaagtgataaccaatcagaatttcccattagcgccagaaggggtctatatttacaaggatgtcaacttttcaggtccctatacattattgaaacatagtgtcgcgaactttaaagatattggcatgaatgatacagtgagttctattaagattgttggaccttatgatgttataggttactcagatgcaaactttacaggacgtttcgcaccattggtaacaactgacaatatagattctaccaatattaaaaatgatgaaatgtcttctattcgaattacacgaaaa

SEQ ID NO: 18 - DNA, 5361 bp, Bacillus thuringiensis
atggcagattcgcagttttttttgccagcatattataacgttttagcagatcctccgtttatttcaaatacaaatgtaatagaatctaacttagatgcagcagccggacctgattgtagtgatcccaataatgctttgaatatgctttgttttgcacaagatatatcgactgcttggaataaaggaaaagaatcaggatcgtatgatttacttgaaaaaacaattggtaacagtgctagctgggcgtttggtggttctagtccttctccagggaattatttagatatggctaaaatttcaataggacttacaggccatatcatatttttaggattaactacaacagccggattagcccctggatggattgttgctggacatgttacgaaacggatattggttccgatttcaaagttattagctactactttttggcctaaaaagaatgatcctaattctgcatctgataatacttggcatttagttagtgacagagttgaaacattagtgcaacaagatattactgcatatgattcaagttcgttaacacaatttatagctgggtttcaagctgtactggacgatttacatgaggcagtagctgtagctatttgtcaaggtcaaagtcctgataatcaaacggcattaaattgtaaaccctatgcggatgaggtattaaatgaaaatgtaagagttaaatttgcaacggcagaagaaacatttcgatctttgcttcctcaatttcaaaagtcaggatatgaatttacagagcttccacaattttgtcaagcggctacgttacacctttctttattgcatagtgcgataaatatggcagacaattggggaattcctccagcactcaaaaataattatgcagctcaattacgtactcttattcaaacatatactcaatatgtatattctacatttgaaaaccaaagacaaaaagttaaagcaagttcatgggataacacaaaccagacgtggaacggagttccgaaatctggaattaatagatatttgcaatttttacaagttgctattttagaatgtttagattatgtagcaacttggagattttatgatgtatatgattatccattacctgcacagtcagacttttctcgtattgtatttggaacaattgtaggtccatctgaaaatgttcataaaaatccaagcgataaatacaaggggtatgatgatgaccctgtagttaaatttgtagattttgatttaaacacaggggcaaataaaagccctttaacttggcctgattttgagaataaaacatatatgcctattgatttagatccaggttctacttcttttcatctaacagcacatgatctcaatcatatatacgtagatggcatagaagttggatataattatacagatgtaatagctagaacatcaaaaaaagtaactccaaaatatgcactacgcgacaccgtcagcccgaatactggcaatttcccgcaagaccagtgggcccaaattaaagctacatcattaatcgatacgagctataaatattatccattaaattttatcaatataggttcccgacagacagaccaaatggattacagtgaagtttcatggagtattaatgataattcaaatgatgaccatagcactgacctcgttttcattaatgctccctttactaacaacaattgttcgtatccaaaaccaaaagatctgggatctggttatgatgacggccaaccttgtcaatccaatacccacacacttggtacagatgtcattcgtgtcttatatcctgtagttgctcaaggaggaaaaagtacaaataaaattggttttcttccactctatatgcatacaaatttagagccaacgaatattatcggacagctggatccagatgcaccagaggatagtgatagtagttcagagattcgaatgttgcaaactagaaccattccggtggaaaaaggagttctaagcggagcagcaacaaatgtagtagaacgtgtaacaggttccaattcagttcttttaaaaaataaaggatcagttaaagtacctattacagttcaaacaggaggaaaatatttcattcgtgttcatgcggctactacagcaaaagatgggaaattatctttccattttgattcaccatcatacaaaccaccggaggattttaccattactttagagaatacaaaacaatatttagatgatacaacatgtaatcctaataattcatgttataacacagtaagtcgagattgttcaacatgcgatgagaataccggtaaaaataccggttccacttgttaccatacagatactaagacatgttcagcaccatcacatccaatgtggatacaaggtgtggagaatcgtgtatatgcattatttccgaaaatgggaatagatacaaataatcctggtaatcctgctattcctcaaagtacaattgtagaacttatgccggttaattataatattaccattacaaatacgtcggatgttgatattattatagatcgaattgaatttatgactattccaaaaatggaacaggtatctacacctccaagtggaaatgaaactgaaaaacaaatagctgaaataccaactagtcaagatttttatgctgtaagtggttcaccgacattgatttgggagacatatgacaaaacagtactaacacgtgcagaattgaatttagaaaaccctccatctgatattttaaattcatatcagtttcaattttattatgataccttccctcaatcagcaactaaaacgacaacaaatggcatcgattcttattctgttccaagtggattcaataaaattatatttacttcaactgtctcacaaacagaaccatttaagctatctggaaaaatttacgaaccaattcctcctatagatcctccaggagcaccaccaactgaaaaacaaataggatcgataccaaacggtacaccatttataggcggggataacctaacaacaactatttggagttcactcgatgggactttagcaaaccatgcggaattgacaatagaaaattatccatctggttttttgaattcatctcagattcaatttctttacaatggtttacctcaacaagtaaataaaaagataaacggtaaccagggatcttatgtcgttccaaaaggattcaatcagattctattaacttctactaattcaggaatggtgactttcaatttatctggaaaagtttacgcaccactttcacctttagacccaccagtacaaatagaaacagaaagacaaatagatacaatagcaagtggtacaccatttatggtaggagcagatcattcaacaaccatttggaatatggatggtgctgcagcatacagggcagaactccaattagaacattatccatctgattttttaaagtcagctacgattacattttctttcaataatatctctcaaccagcaattaaaacaacaacaaatggtattgattcttattccgttccacaaggattcgataggattactttgctttctactaactcacaatgggaaaccatcactctatccggaaaaatttacgaaccgattcctcctataaaaataataggtacgatatcaaaatcacattatatgcaaaacctcgactccataataatttggagttccgatactgtaggacaaaaagcaacaatatcaaacgatgccacaattcaggcactgtatgaattctttttaaatgaccagaaagtatcctcatatcattccacaccaggtaaatatatggtacctggtgtcgattatatagacgtaggtactgattttaataagatttctttctctctgaatgcgcctgggaatgcacaaaatgttgatatatcaggaacagtttttgggccatcaaaagattccgaaccctcatctgtgtttaccaaacaagaagatttagataaaataaagcaactggtaaactcattgtttcatgatgtgacacatacaacattatctcctgttgttacagaatattggattcaccaagttcgaaagaaaatattagcattatcagatcaaaaatttggtctacagaaaaaggagttacgtaagttattagttctagcacaacggttaagtgcaaatagaaatttactttcaaatgggaattttaattcgtcgactgattggctattaggacgtcacgtaaaaatattctctgataatactttatttacaggtaattatgcatttttaccatcaccagtccaaaattcatcctatgtatttcaaaaaatagatgaatcaaaattaaaaccaaatacacgatatatcattcgtggatttgttgcaaatagtgaatatttagaagtagtagctgctcgatatggaatagaagtacaacaaatgttaaacgttccttatggaacagcattaccaatttcttcagatagtcaatcaaattgttgtaaacacatgaatactccatgtacgccaaatattcctgataatgagcaagctcatatatttaatttttcaattgatgtgggatcattgcacccatcaattaatttaggaatcgaatttggtcttcgtattgtgaatccaactggttctgcgagagtgagtcatttagaaattgtagaagaacgtccactcacagcaaaagaaatatgtacagtacaacaaagagagaaaaagtggaaagaactcttcacgaaagaacatgcaaagatttctgcacttatacagtcagtccttcaacagcttcttccactttataaagatcaaaattggaacaattccattttagatcatgtcacctatcaagatttcttcaacatctctttaccagaaatacctaaattaaaacattggtttatggaagatcgagaaggagagtatttccaaataacaacacaaattaggcaagcaatctatcgtatttttacacaattagaagaaaaaaacttacttcataatggtagtttttcaaagggactaacagattggatagtagaaggagaaccaagaatgatttccttaggaaagcacatgtctgctttacaactttcaaattttgaagagtctgtatcgcaaaccatcactatcaatgaattccaagaagatcaagaatatagacttcgcatatatggaaaagggaaaggaacaattgtaattcagaatggtgatcaagtcgaaaccatggcatttgcttctaatgattttaaaattcaaatgaaatatctctattttgatacatcaacagttactatagacattcaatcagacgagaagaaattcctagtagcaagtgtagagctttttgaagttccatcatcatcatcaccttcctgtaat

SEQ ID NO: 19 - DNA, 1191 bp, Bacillus thuringiensis
aaaggaatcatggttttcaatcttttgttgatattgttttaaaggcataatgattggtttctttgctttattaagtggttccaattttacttctgttgcacttgcttctgataaatgacctgctacacctgtatatttagatgtaatttttccaaatgatacagttttctctttgtcatctaacttaacataagatggaattggtaaatttgaatacttatataaattatataaaaattcttttcgatttgggattgtataatctcctttttctttatatttttcattcttatatttccaatttttttctatagcatccattaattgatctacagttggttcaacttcaaaactcattgtaccagaaaaattagcctgagataattttacaattaaagaagttttatatcctggtaaacattttagtgattgagatggatatgtaactgttttttcagtggaagatgtattcgaacttgtatgattataagttgcttcaaatgacatggtaagagtttcttgagcttgtgctataggaattcccgctctaattgtcgtcgtagcagaagctcctaattttccaccttctgaattagaatatgtaaaagaatctgttactttttctgtttttgaaggagtcaaaaaagtttgttctgatgatgtagtattagtataagtagctagttcaatgttatcttctttataattatccactcttggattatctaatttaatttcattttgattagaaagattggtatattcaggaacccaattaaaaaacggatccattccaaataactttagccattctggattatcctctaaagttctgtccaacttatgatctcttatttcttgagcaagcccagcgaatgcttcttcttgatattttatatcactttgtttcgttagtggtttcacaccagatgaagtaactaaatcagggtgttcgattatcattctctgatatcgttcatatagatcccccgctaaagtatatttactaataggttgaaaatctgacatagaatttgctgtagcataatttgtagttactgcagctgcagccggtgtcggtttagtaacaaacgttaatcctgttcctaataaacaaacaattggagctacaattgctacttttttatatctcttaatggaatacatatagtacatctcctttgttaacat

SEQ ID NO: 20 - DNA, 1152 bp, Bacillus thuringiensis
gtgactaaaaatgctcactcgatcaaattactgatccaaaacaggagcatctatggaggttttattatgaagaaaaaacttattgcagctaccgcagtattgactctcgcagtaactggactagaagcagtcatacccgttaatgccctagcttctgatcacgtaaaaaattatgtgttgcaagagcatatagaatcgaaagtatttgatttagaatcattgcttttgaagcatacaaaaaacgacattttcctctccgctctaagcacttctactggaacggtactaaatctagataccttgaaagcagatgtagtctttggtgagcaagaagtcattgccgattcattaaagaaaaaaacgaactttaagacagcgaatgtatttataaatgaagatcctgagcctcaagcgttcccaactagagaaatatcagaaaatgtatcagatactcactctaaaatgattacacaaggctttaaagcaggagcaagcgtgaaggcaggcttcgacctaggttttaccaagggagacgttacactgaacactgagtacaataaaagtgatcaggaaggcaatacaacagtcaaatccaaaacgattaagtacccatcgcaaaccattacagctccggcgaaatccgtagtagtattagaatatagtctagaagagaataaagcgaaagcttacacggacgtcaacgccgtattagcaggagactatgagaaaaagtatttctttatccctgcccataaatttattcctgatccacttggtattggcatattgactgacctaatagagactggtgatattaaaccggaaaaggaaaaaacacagagatttaacttatatgatgaattagctaataacgatttacttaaagatgacgatccggttacactagatgaaaagaataaaaaagtaattttaaatggcaaaatattaacagattcatctgtatatagtgatagatttattattaaaaagaaaacatactcccttgaggaatatgagcagctccagaaaaacggaaaaagtggaagaagtaagagggatgtttctagcttagatgcttctaaaaaggacttttctgctttgactccgatcgatgaagaaacatataccgttgaaggcatcgtaactgaaaaa

SEQ ID NO: 21 - DNA, 3867 bp, Bacillus thuringiensis
atggttattttaaatgatatttataaaggaccttataatgtattagcaagtccaccattattagaaacaaattcaatagatttttctgatctgataccaaaaataataaaaacagtaaaagacacagctgaaactggtaaagtaagtgaaatattaaatttaaaaaaatttatagatgaagggtatggaaatgacactaatgtaatggcagcaatttttcaaactatttctactctaatacctctagcttatccaccagctgctgctgttttacctattattggtgcttttgtaaaactgatattccctacaaattcaaaatcaacttttgatgttcttaagaatttaattgatgagaaaatagacaaatctataacaagtttagtctcgcaaactctaattaatacaataaaaaatttccaaaataatgtagaaatagtggaaaatgcaatgcgcacggctattggtacaggagataaaattaatacacttacaaaaaatctaaatgaacaatcttgttcgactatgtttgatggacaaacttgtccttgcaccccatcagataagtgtttagataaagttagaaccgattttgaaactgctatagccattattcaacttaatgcatttgaaaacccttttggtgaatcggtttcaaaacctgaagatggatatttatatgcattaccattatttgcaaaatcagtcactttgaaattatcattacgtcatagttacattacttttatgaaaaaatatagatttgttagtgaagaagtttatactaaagctgatataccaaaagtattaattgatcaacaaaaagaaattaaagaatttacaagacggatattaacaacatttaataatcaattttttaataaaatcaacccaaattataattcgccagataaattagaaaaatatattaattatatgcgaattatgcaattagaatgtttagatttagtagccttatggcctttctttaaccctcttttatatcctaatggtgccaactatcaatttacacgccttattttccaaaatttagcgatacctatgattcgttatactaacaaacctacagcaggacattataatttaagaggtgtatcaggaagtattccaaataatgatattttcaggtatacctattctggtatgagattaaccagcgcagcttttatgacttataaaaatggtgaaaaatacaatgtagatggtgaatatttaactttttcaacaaattattccaacaaagattattatataaattcatcaaaaaatgatcatgatacagttggagaaaacatattttcttatggtatccccatatcattacgtttaaatagttctataactaatgcaaagcagcttgctcctgatgacgatcaaacatcgttattcgctaaatttctgaactcagaaaattgggtttactttgctggaaaaccagaattaacaggaggaagctatggatataataatccacccgttccaaaccacaaaatacaaggagtgtatccacttgttgatactaatcaagttggttatgcttacaaacgaggttatttacaaacattaatatctaatgatatcaccccagaaaatatactccagtatatagaggagggtaagacatttacattcccattagacaaagtagaacaagtaaataataaactaagaatagaaaatccatatgactctacacaggttgaattcgcaaatggagcaaatgctcttaaattgtcaggtggccaaaccacaatattcccaattaaaaccatgtttccgaataacacaacagtatcttgtcaagttcgaattagagcagctacaaatgcaccaggatctcttgacttagatattgataataatcaaactataaaactccctcttgacaatacttccactattactagtgatcaagtaggatcatatggaacaaacggaacagatgactctttacctttatatgttgtatttccaagaccacaagtaaaccaaaaagatggagaattaatgccaccgacagaagctataattaatttgttagcaggaaaacaatataatattaaaataacaaattcaggttcctcagacatcatattagatcgtattgaatttgttttatttaaaacccaacaaaaaccaaatgagatctcgttattaccacaaacttttccatgccctaatgaacagccaactctgtggggaacttctggcggtcaacaacaagctacaggtatgcgcataactcctgacggaagagttgactcttcaccaattgtattatacctgaaaggaaagttcgtttggtcccttgaccctaggactgaacatcttgaggtccagaacatattatttgatcaggtaaaaatgggcagtacatgtggctcaggcgcaagtccttcccttttcaacggaggtattattactttagcatctcaatcttttgataaactagaagatttagaaaaaatcacaaaccaagtcaatgccttatttacatcctcatcccaaacagaattggctcaaaccgtaacggattatagaattgatcaaatggtattaaaagtagatgcgttatcagacgatatatttggtgtagagaaaaaagcattacgtaaacttgtcaatcaggccaaacaattaagtaaagcacgaaatgtattagttggtggaaactttgaaaaaggtcatgagtggatactgggtcgtgaagcaacaacggtagcggatcatgatttattcaaaggagatcatttattattaccaccaccaacgatgtatccatcgtatgcgtatcaaaaaatcgatgaatccaaactaaaatccaatacacgctatacggtttctggttttgttgcgcaaagtgaacatttagaagtcgttgtttcacgctacggaaaagaagtacatgacatgttagatgtcccttatgaagaagcattaccaattacttctgatgaacgtccaaactgttgtaaaccatctggttgtcagtgtccatcttgcaatggtgatgcaccagactcccatttctttagctatagtattgatgttggttccttacaaacagatgtaaatttaggaattgagtttggtcttcgtattgcgaaatcaaacggatttgcgaaaatcagcaacctagaaatcaaagaagaccgtccattaactaaccaagaaatcaaaaaagtacaacgcaaagaacaaaagtggaagaaagcatttgacaaagaacaaacagaagtaacggcaacactccaaccaaccctaaaccaaatcaatgccttatatcaaaatgaagattggaacggttcgattcaccctcatgtgacgtatcaacatctgtctaatgttgttttaccaacattaccaaaacaaacacattggtttatggaagatcgacaaggcgaacattacagtgtaacaaaacaatttcaacaagcattggatcaagctttccaacaagtagaagaacaaaacttgatctacaatggtaactttgcgaacggattgacagattggactgtcacaggagatgcacatattaccatccaagatgatgatctagtattagaactagcacattgggacgcaagtgtctctcaaacaattgagattactgattttgaggaagaaaaagaatacaaacttcgtgtacgtggaaaaggcaaaggaacggtaaccgttcaacatggagaaaaagagttaaaaacaatgacatttaacacaaatagttttacaacacaagaacaaaccttctatttcgaaggaaatacagtggatgtacacattcaatcagagaataatacattcctaatagacagtgtggaactcattgaagttgtagaagaa

SEQ ID NO: 22 - DNA, 4356 bp, Bacillus thuringiensis
atgaatcaaatatacgtgagtaatgtagcggaaatagaaggaatcaaaagggccaaagaaaaatatcctgatagagagatacctgtttaccaacatacagtaacctcacagaatttatgtgcaacaatcaacccaccgaccttggttatgaatacggatatgaggggaacaaacacgtttgagaataaggattcctttcagaaaacacaaagttcagatttgcgaaatataaacctttctgaatggcgagatttgggtggaaatgtgaattcaccgcaatttaccaaacaaagactcatagataatgggcaaacatccctagatatcgatttggaaattggagtcacttcagctgcaggtatcgcatgggctttactaggcatatcgcatccgataggatcggcagtagcgggagtcgtaaatgtgatcctgcctattctttggcccactacgactgaggatccagacgaagtatggaaatccatgatgggaaatgcagaggctcttgtagataagaaaatagatgaagcgatgaaaaacctggctatttcgaaattaaatggattaaaaaattcgatgaatgaatattgtcaggcacttgctagattaaaagcggacccaaataatccaattgaacaagcgtcggtacgaagcgcatatcagtctatggatatgctattcctatacagcatgcctcaatttgcggttcctcaatttgaagtacaactattaccaacctatgcagaagcagcgaaccttcatctgcttttcatacgtgatgcggtgaaatttggaaacgaatggggtatgacgcaggctcagattgacacagaatataatgatttaaaaaggctcactgaagagtatacgaatcattgcgtgaattggtttaatactggtttgcaaaggatggatccattcaagaatccaagtaaaaagcctgctgatatgtggaattgtacaacgtatccatgggttgcttttgatcaatatgtttcatggtttggcacaacgcaaaaccctcctaaaaattgcaaatccacccttcaaactagtatatgcgacaatcaaggaattgaaaatgattcagaagtaacaccccaattagggagttaccgaggatcaaaaagtgaataccaagggttagaaaattggaatttatataataattttagacgtgacatgacgattatggtattagacgtagtctcctcatggccaacatatgatcccataaaatattctattggagggatacagtctgaacttacccgcgctttgtatacgcccatacgtggaacaacatatagaagtgattcagctcaaaatactatcagtgcgatagagaatcggatgattcaaaagccccacctatttacttggttaaatagaattgaatttaacgaattatgggtaggtgataatctttacacgaaaggatatgttttgattggcggaaaaataataagaaaattcacttcggaatcaactgtggaagaatcatttggaaaatctgacccgagcgcgagaaaaatgaatgtagacattacgccgaatgaccctattaaaaaaattattacaagacagtggtttgagccaagagagattgaactttataaaggagctacatatctttttacattaggaacaatacaagaaccaatgccgaattttaccggaatcatcacatcagggtgctaccctacaggcggagtaccgaaaccatgtatttatgatccaacaagaaaagaaaatatgatgccaaaagcagtagaccctaataccccaaacgctcccagatcacagtggaaagattcccatcgtttatcatattttaaatatgaaccaattcgaagtaactcgccctatggatatccttcccagggacagattggggctgtggcgttggaatggacacatatgagtgtcaaccccaacaatacaatcgcgctagataaaattacccaaattccagcggtgaaaggctgggagctgagggggggagcaaaagtcataaagggccccggtagcacaggtggggatttagtacagttatctggtgacttcaatgacttaacggtacaggtgaccattccttcaagtgaggtaattggaggctatcttataagattacgttacgcaagtaatctgaatactaagatttttataactttccaaggtttagaaatattatcaaatgtattcgatcttcctgctacgtattctggtggagatttaacatatggtactttcaaatacaaagacaccttattaattccatcccctgactttgaaatcattacaacaatagatttatctaatgacaacaagagtagtaacatcatcatcgacaaaatcgaattcatcccgattaaaggtcctttggaagattatgaagcaaatcaaaagttagaaaaggcacgaaaggtcgtgaacaccttgttttcagatactgcgaaacaacgcttgaaagagaatataatgggtgttgatctggatattgccatgggcttgatagaagaaataccagatgatcgatttcaaaaagaaaaaatgatcctccgggatcggattaaacaggccaaacgtatgagtcaatctcgtaatcttttgcaatatggggattttgcatcaccagattggtcgagggagaatggttggaaagtcagcagggatatttcggtggaatctacgaatcccattttaaatggcaagtatctcaatctgccaagtgcccgagatccattgtctgatggtaacgtctacccttcctatgcgtatcaaaaggtagaggaatcgaaattaaagccctatacacgttactggattcgcggattaatcggaagtagcaaagatttagaactggttgtttcacgatatcgaaaagaagtgcacaaaatattgaatgtgtcagataatctgaatgtaacatcattacgaagccatttggaatctttaagtgactcagatatgctaggacaggtacgcgaaacgttacaaaatgtatcttgcggtccatatttaccacttcttcaaacaaacaatccaggtgaagacccacatatcttctcttgccacattgatgtaggagagttggatccaagttgtaatccaggaatcgaggttgctttgaaaatcaacgcagtagatggaggcgcacagattcgttacatcgaactcatagaaggagcaccactaacaagcgaagaaatggcacgagtaaaacgacaagagaagaaatggaagcaaaagagaaatcaaatatttatccggaaccaagctgctattcaagctgcccgagatgcggttcatcgcttatttgtaagtccaacatgcggtcgtctgaagctcacaacaacactgcaaaatattgaatatgcacaaacattggtaaatgcgattccggatcgatataatccgattctttcggaattaccaggtgtgaatatggatatttttggtcacttgcaaaaccaacttgaaatggcatacgggttatataatactcgaaatgttgttgtcgatggtgactttatgagtggtcttgcaaactggaatgcgaccgaaggtgccgcgatgcaacaaatcgatggtacatctgtcgtggtcatttcggattggggggcaaatgtgtcacaagaaatttgtgtgaatccagaacatggctatctgttgcgtgtgaccgcaagaaaagaggggcttggaaaaggctatgtaacaatcagtgattgtacggaaaataataccgaaactgtgacgtttgtatcggatgaagacaggatggcgtataccgaatcccttcgtgatatgtctatagagacagcgagtatgggagacgctccatacgaaggcgatagtaataccctaaatgtgccacctgatcgatatggaagaaatacatcctatgcaggtaatacaaacatgaattactcatcagagagttttggatttacgccatatggtgatcaaaatcaaatgatgaattatccgtctagcaatgatgaaatgagtgtgtatgcgaataatccgaacatgacaaatggtcatggaacgggttgtggatgtggttgtagtacaaacgcatactctggtgagtataagaaaatgaatacaccacctaacaattatgaaatgaacgcatactctacgaacgaaaataccctaactaatgatgaggcaaaatatgaagcagcgtcgtattcttctccgattccagaacaaaacggttcattcctttctggttatgtaacaaaaacagtggaaattttcccagaaaccaatcgtgtccgcattgaaatgggagaaaccgaaggtacatttatgatagaaagtgtggaattgattcgcatggagtgt

SEQ ID NO: 23 - DNA, 4071 bp, Bacillus thuringiensis
atgggggtattgttgatgaatcaaaattataacaataatgaatatgaaattttggataatggtggcataagcaatcagccaaggtatcctcttgcgcaggcaccaggttctgaatggcagaatatgaattacacagattgggtgaataggtgtaattgtggggaacccggagaattattcaacgatactacaactgccgttaggaatggactcattattggtacaggggttggatgggcactccttggattaattccagttattggtggtccagcatccgcgatagcaggacttttcaacgtgctgatcccatactggtggccagaacaggcaggaaatcctgggactgcccaagcacaatttacatgggaacagttgatgagtgctgtagaaactatcactgataaaaaaattctaaattttaaaaaatctgatgccatcgcacgatggcaagggatacaactgttaacgagagactattacctaaagctctgtgactggataaacgaccagacgtcccctagcaaacaggcagcagtgaaagatgcattcgatgacgttgaggattatataaagatatcgatgccattctttgaagcacaaggttttcaagttcaaatgttatccatgtatgcacaagctgctagtatgcacttacttttgttacgagatgttgtcaaatatggggtaggttgggggtatgagccatatgaggttgaacgatattattcccacattggcctaggaaataagggattactacaactaatagcagactatacagatcattgcgtggtttggtacaacacaggtttacaggaacaatataacactggtgactggaataaattcaatgattttcgtagagatatgactataatggtactcgatattgtatcaatatggccaacatttgacccaagattatatacagttcctacaaaatcacaacttacacggactgtatatacacgcgtatcaggagatacaggaggtggaaatattactgttgaaccaacattacccattgacgtggtagaatctaatgtagttgatattcctcgattattttcatggttacgtgagttaacgattgatgcggataacttcccgtcctctagccctggtcgcttcgacatgaaaggtcgtggactaaaacgtcaaaacactttgagtaacacaatagaggtgggaggatacaaaggagaggccggaaacaggcaacagaccctttctattccatcaccacaatctaatgatgacgtctggaagattgacactttaataagaatagcattcaatgatggaagtagggctgtaaatggatgggattttaaattcactcaatctcctaatcaacatttatatggtacccctttctttccacaagaagtggcagggttcccttgtaaaggtcagaatctccgtccctgtgagccgtgtgtttcttgttctagtgagcttcccgacatgaatgttccttgtaatgacaaatccctttatagtcatcgatattcatatatggggctcggtatgttaacgtacaattctaccactccatttagatacgcagcctattttagcaacggttggacccatgtaagtgcagatgcaaacaatttgatagaccttgaaaagattacgcaaattccagcagtaaaaggatattcgttaactggtacttcccgtgttataaaaggacctggtagtacgggtggagatttagtaaaactctctgcaagtggaatgctggggttagccataacagaaccatcagggacacatgcatatcgtgtaagaatacgttatgcatgtaatatggacattaacatattagttttaaacgaagttactgcggagttggggagatttattgctccagctactacaactgatatgacaaatctcacatatgataaatttggatacctagacaccttagtttattcttatagcagtcttgaagatgttaacaatggactgaatatctataacttaggttctgatgaagcaacaataattcttgacaaaatcgaattcatcccaattcaagggtcagtggaaacctatgaagcggatcaagctttagaaaaagcaaggaaggcagtgaatgacttatttccgaatgatgcgaaaaataccttgagattacatgtcaccgattacttggtggatcaggcggcgaatcttgtagaatgtatatctgatgaagtccacccaaaagaaaaaatgtgcttgctggatcaagtgaaagtagcaaaacgacttagtcaagcacgcaatttattgcaccatggtgattttgaatcacctgattggtctggagagaatggatggaaaacaagtaatcatgtgtccgtcacatctggtaatccaatctttaaaggtcgttatctccacatgccaggtgcggagaatccacagtttagtgaccaggtatttccaacgtatatgtatcaaaagatagatgaatcgaagttaaaaccatatacacgttatctggtacgagggtttgttggaaatagtaaagatttagcactgttggtcgcaagatatgataaagaagtacacaagaacatgaatgtaccaaatgatatcccgccaatgaatccgtgtaccggggaatatcatttgggagaaggaccgatgctcacaaattatacgataccacaagacatgtcctgtgatccttgtgaggctggaacagtgatgaaggtccaacagacctttgtaaaatgtgaagatccacatgtcttttcgttccacattgatacgggtgagctggatatggagcgaaatctgggtatttgggttggttttaaaattggaacgacagatggtatggcaacagtagataacttagaagtgatagaagcgaatccgttaacaggagaagcattgtcacgtgtgaaaaaacgtgaacaaaaatggaaacaaaagtggacagagaaacggatgaagattgaaacggccgtgcaaacagctcaaggtgccatacaagcgttatttacaaatgcaaatcaaaatcccttgaaaccggatatcaccctaaacgatatcttacaagcggaaaacttggtacaaagaattccatatgtatacaatgaattcttacaaggggccttaccacccgtaccaggtgaaacgtatgacatcttcttacaactttccagcgcagttgcgagcgcacgatcgttatatgaacagcggaatgtgctgagaaatggtgatttcatggcaggattgtcgaactggaaaggtgcaaaagatgcgattgtccaaaagatcgggaatgcatctgtactggtcatttcagattggagtgctactctttcgcaagatgtgtgtgtgaatccagaacagggatatatcctacgtgtcacagcgaaaaaagaagactctggagaaggatatgtgaccatcagcgatggaacgaacgacaatacagaaacattgaagtttacagcggatgaagagatgacgagtatggcgcagtctgatatacgttctccgattcgcgaacgctatcaggagcggaatatggtgaatgcttctgaagaagcatatggaacaaatggatatgcgagtaatccgatggcaaactacccatcagacaatgatagagcgaatacccactctagaaataattataggacttacccatcagaaagttttggaattacgccatacagcgatgaaaatccgatgacggattatccaaccaacaagtatgagatgaatacttatccaggtagcacaaacatgacaaatccgaatggaggatgcagctgtggctgtagcacaaacacatatgctggtgaaaatatgatgatgaatgcttcatccaatgcgaatgggtcaggttacggatgtggttgtcgtacctatataaacaacagtacagattcctatgcgtctcctatgaccgcacgaaacggttcttctctctcaggttatgtaacaaaaacagtggaaatcttcccggaaacgaatcgtgtctgcatagaaatcggcgaaacatctggaacatttaaggtggaaagtatagaactcattcgaatggattgcgaa

SEQ ID NO: 24 - DNA, 2421 bp, Bacillus thuringiensis
atgggaggattgttgatgaatcaaaattacaaccacaataactatgaaattctggataatggtaatagggactatcagccaaggtatccacttgcgcaggcaccatgttctgaactacaaaatatgaattatcaagatgtgatgaacacgagtatcggaagagaatatcaggcagtacaacaggtaaatgtgggagaggctgttagtgcagcactgggcattctgacaaccattcttaaggcagccaacccaacattgggagcagcagcaggggtcatcagttcaattttcggatttctttggaaacgatttggaacagatcctcaagcccaatggaaacagttcatggatgcagtagaatatttggtgaatcaaaaaattacagacgcagtgcgaagtaaagcagtttctgaattagagggcgtacaacgagcgttagagctttatcaggaagctgctgatgattggaacatgagtccgaatgatgcggatgccaaagagagaataagaagacaatttacctctacaaatacagtgattgaatacgcaatgccatcatttcgagtagatggttttgaggtgccgttattaacgacgtttgcgcaagctgctaacctccatttactactattacgggatgcggttaagtttggagcaggatggggtttgccttctgcagaagttgaggataattatactaggctccaagcacgtacagcagaatatacaaatcattgtacaaatacctatgataaagggttaaagcaagcttacgacttagcaccaaatccaacagattacaataagtatccctatctaaatccacattctaaagatccgatttacggtaaatattatacagctccggttgattggaatctatttaatgacttccgaagagatatgactttgatggtactagacattgtggcagtttggccaacatataatccaagactatataacaatccgtatggtgtgcaaatacagctttcaagagaagtttatagcacggtatatggaagaggtgggtctactaattcaacagtagatgccattgaatctacccttgttagacctccgcatttagttacagaactaaccaagcttacatttgatgaacgtaatttatatgaagcggaaacagtgcctgttgcgtttaaaaaggttacaaatacgcttcgtaatgtaggaagctcaaccacatgggagcaaagtttttcctcgactggaggatcacttaagactgttcataatgtctgggctaccgatataggtaatctttcattaaatctaggagctgtacctttggggttttctttctataatgaaaacgatcaacatctaactacagttggctactctggaggtttgtggaatgggatacctaaaggcgaaggtagtaatcaaaacagtcatcatctgtcatatgttgcagccctagaaacgcaaagtacagctggttggtggccttatacgtatccggtgaatttgttaggagaatggggatttggttggttgcataatagtttaacgctagataatagaatagcaaccgataaaatcactcaaattccagcagtgaaggctttcaaactcacaccatataataataatacaaaagttattaagggtcccggtagtacaggaggagatctaatccagttagcttctggttttttacaatatagttttccttcaaccgacaaccgacaataccgtattagaattcgttatgcaagtgcggatggtagtgctttaaggctcagacaatggattggtaatggtgtatcagattctacccataatcttccgaagacatactctagcggtccattaacgtataatacatttgctatttttgatactggacgaattatgcaaaccactagtagtttcgaactttggttagataatataggtagcggaaccctaatcatcgacaaaatcgaattcattccaataaacccgattgaatcgccaccagaaccaaaaccaccagtacttcccggtacctatcagataatttcggctttaaataatagcagcgttgtagatatggatccaactagtaaaaatgttcaattatatgggaatggtaatgcaaataatcaaaaatgggagttagtatttgatccaagtcaaggtgcatatcaagttgaaaatttagcaaatacaagtttagtattaacttggcaagtgatgcaagggcttaatgtaaatgctgcccctaatctcggcaatccagaacaatattggataattgaagatgcaggaaatggatatgtttatttaagaaataagaaagatcggaacaaagtattagatgtagatcattcaggtactgcaaatggaacaaatattcaggtatgggattataacgggagtaatgctcaaaagttcaaacttaataggttaagt

SEQ ID NO: 25 - DNA, 2037 bp, Bacillus thuringiensis
atgaatcaagatgttacaagagcacgagaggcagtttatgccttattcttgaacaatacgttacaattgaaagtcacggattaccagatagatcaggctgcgaagctcgtagagtgtatatctgatgggatctacccaaaagaaaaaatgtgtttgctggataaagtgaaagcggcaaaacgactcagtcaagcacgtaatctattaaactatggtgattttgaatccctggattggtccggtgataatggatggaaaacgagttatcatgtatatgtcacatcggataattccatctttaaagggcgatatttgaatataccaagtgcaaataaccctcagtttagtgacaagatattcccatcgtatgcatatcaaaagatagacgaatcaaagttaaaagcatatacacgctatatggtaagaggatttgtcggaactagtaaagatttagaactgttggtcgcaagatatgacaaagaagtacacaagaaaatgaatgtaccaaatgatatcttaccaacggatacatgcacgggaggatatctgttggaacaaggctcttatccagttctaacaaaccagatgatgccacaaaacatgtcatgtgatccatgtgatactggatacagaaatgaagtaggaacgatggttccaaatacaagtatgatgtgccaagatccacatacatttaaatttcatattgatataggcgaactggatatggatcgaaatcttggcatttggattggttttaaaattggaacgacagatggcatggcaacagtagataatctagaagtagtagaagtaggtccgttaacaggagaagcattagtccgtatgcaaaaacgagaaccaaaatggaaacagaaatgggcagaaaaacgaatgaaaatcgaaaaggcagttcaagcagcacgaaatgcgatacaagcgttatttacaagtccagatcaaaatcgattgcaatcggcaatcaccctgcataatattttacacgcagagaaattggtacagaagattccatatgtatataaccaattcttactaggggctttaccatcagtaccaggtgaacagtatgacatcttccaaaaactatctgatacaattgcgctagcacaatcgttatatgggcagcggaatgtgctgaacaatggggatttctcagcgggactgtcgggctggaatgccacagatggtgcggatgtacaacagatcgggaatacatctgtgctggtgatttcagattggagcgcaagtctttcccagcacgtgtgtgtgaaacctgaacatagctatcttttacgtgtaaccgcaaaaaaagaaggctctggagaaggatacgtgacaatcagtgatggaacggaagaaaatacagaaacattgaagtttacagtaggcgaagaggcaacaagttcgccatcgtctgatattcgttccaatcttcgtgaacgctataatgaacagaatgtgccgaatgcttctgaagaagcatatggaataaatggatatgcgagtaataatatgacgaactatccatcagttaattatggagtaaatgcatatcctggtgttaataacaatatgaccaactaccaatcagagagtttcggcattactccatacggtgatgaaaatagcatgatgaactatccgtcaaataattatgaaatgaatgtatatccaagtagcacaaacatgacaaatcataatggggggtgtagctgtggctgcggcacaaacacctatgcgggtgaaagtatgacgatgaacaactatccatctagcatgtatgaaacgaatgcatatccaagtagcacgaacatgaccaataatcagggaatgggctgtggatgttattacagtacaaatgaacatccgatggtagaacaaaatacccttgacctttctggttatgtaacaaaaacggttgaaatcttcccagaaacgaatcctgtctgcattgaaatcggtgaaacatctggaacatttatggtggaaagtatagaactcattcgaatgaattgcgaa

SEQ ID NO: 26 - DNA, 4380 bp, Bacillus thuringiensis
atgaacctaaatgataacaagaatgaatttgaaatcatggatcatggtagcatgggctatcagcccaaatatccccttgccaaggaatccgttcctacagggcaaaatatgaattacacagattggatgaatcggtgtgcaaatggggaagtagacgtattcggtgatacttcaggcagtgttaggaatgcccttatttacggtacaggtgtagggtgggcactccttggtttcattccagtcattggtggaccagcatccgcaatagcaggactttttaatgtattgcttccctactggtggccagaacaagcaggcgcgtctggatcgccccaagcacaatatacatgggctcagttgatggctggttcagaagagattaccgacaaaaaaattctggagagtaaaaaatcagacgcaattgccagatggcaaggtatacaaagtatgggacgtgtatattatgaaaagctatgcgactggataggagatcaaaacaacgaagtaaaaaaagacagattacgagatgcatttgatgacctcgacgatcgaattagagtgtctatgccacatttccaggcacaaacatttgaagttcaaatgttatccatgtatgcgcaagctgcgaatatgcacttactcttgttacgagacgttgttacaaatggtacaaattggggatttgagcaattcgaggttgatcgatactattccaatgcagatggcctagggaatccagggttactacaactattaaacagctatacaaactattgtatcgattggtataataccggtttacaggagcaatatgacactggtgactggaataaattcaataattttcgtacaaccatgacaatatcggtacttgatactgtagcaacatggccaacatttgatcccaaattctattcgttacctacaaaatcacaactgacacgaattgtgtataccccaagagtaggagacacagcaaggtctaatagaccatctgcatctatagatgcgcaagaaaataatatagtttctagtccacgtttattcgcctggttacgtatggtggatgtatctctgcagaagaatggtctttctaatgagatagcatcgtataaacaaactttccacaatactttacatactaacctctggtcgataactaagggaacacctactaacgatgtacgtaatatgtttacaacaccatattttccttatgatgatatctggaaaattaaaaatgaatttttcgattatgattctccattcgatgatctggctgtagataactggacgttttctttcagatactcagatgatcaatattttgagctgagtacgtatgataaatcggtcactcgcttctatgggttaccttgtagagccaagaattccggtatttgtgacccctgtgatagtcagaatccttgtagaaaagagctccctaacacgactatgccttgtgaagataaacgactatatagtcatcgattggcctatatgggtgcgggtgaaaatgtttatccccccccaagcttaacctattctgcttatggctggacacatgtaagtgcagatgcagacaatcggattgatgctgaaaagattacccaaatcccggcagtgaaggggagttggctaaatgaaggaactgtaataaaaggacctggtagcacaggtggagatttaatacagttgcattcatatggtactagtatagcactatctgtaacgatacccgcaggaattcagacatatcgtgtaagaatacgttatgcaagtaatgcggatctacctatacttgtttctctgggctactctggtctcgatacctttattgccccagcaacgactagcgatttaacaaaactcacatataataaatttgcctacctagataccttggtatttacgagtagagaggatccaaatggactgtatgaacaattgatatttattaggcataatggattggagtcaagaaccttcatcatcgataaaatcgaatttattccaataaaaggatcagtggcagaatatgaagctagtcaagctgtagaaaaggcacgaaaggcagtgaacaccttgtttacgagtgatgcgaaaaatgccctgaaattgaatgtgacggattacgcagtggaccaagctgccaaccttgtggagtgtgtatcagaagacttccatgcccaagaaaaaatgattatgctagatcaagtcaagtttgcgaaacgactgagtcatgcacggaatctattacactatggagattttgaatcctcagattggtcgggagagaatggatggagaaccagtcagcatgtccatgtggcatctgataatccaatctttaaagggcgctatctccacatgcctggtgcgatgagccctcaattctctaacaatatctatccaacgtatgcctatcaaaaagtggatgagtcaaaattaaaatcctatacccgttacctggtacgtggattcgtcgggaatagtaaagacctagaattactggtagaacgctatggaaaagatgtacatgtagaaatggatgtaccaaatgatatgcaatatacgttaccaatgaatgaatgtggtggctttgaccgatgtcaaccagtctcctatcaggaaagacctcttcctacatgcaaatgtaaagataccgctgtagcgcatacagattgtaagtgtaaagataaggaaagtcgtacttcgacgaataggtatacatttgagccaacaggtaatgcggtatatatgaatggatctgatcacaaatcatgtggatgcaagaaccacgacatgtatcagaacggaacacatccacataagtcttgtggatgcaaagatccacacgtcttctctttccacattgacacaggatgtgtagatgtagaagaaaacgcaggccttctattcgcactgaaaattgcgagtaccgatggtgtagcaaatatagataatctcgaaatcattgagggacaacctttaacaggagaggcattagcacgtgtgaaaaaacgagagcacaaatggaaagaagaaatgaaacaaaaacgctgtaaaacaaaagaagctgtagaggctgccctaacagctatcaatgccctattcacaaacaaacaatacactcgattaaaatttgagacgttgttcccgcacattcttcatgcggatgaacttgtacaacgtattccatatgtgtatcacccattcttacaggatgcatacccggatgtaccaggaatgaactatgctattttccaacaactctctgccttggttgttcaagcacgtggattatatgacatgcgaaatctagtacgaaatggcacattcagtgccggcataggaaattggcaggtaacagacggagtagcgacacaaccagaaggaaatacctctgtactgattctacgagaatggagcgataaggccctccaacatctacgaatccatgaagaacgcggctatgtgttacgtgtaacagcacgaaaagaaggcaatggtgacggatatatcgtgatccatgattgcgatcatcaacaggagaaattgacatttacagcctgcgattattctacaatgagggcaagtacaggtacgcaaacgatgatgacacctcctacaaattgtatgccatgtaaatcaacaacatggaaggacgagatgacaacatctgtacctatgttgagtgggtatgtcacaaaaacagcggaaatcttctcggatacagatcgtattcgtattgagattggcgagacagaaggtatgttcaaaatcgaaagtgtggaactgatctgtatggaacacatggaagaccatatgtatgatatggctagagtaggtccagcaaaagccgaagaacatccaattttaaaagatgcaaacggtagtccggttgtatatggacaggaatattacatggagccctatgaatttccaggttataaattaggagaaagcatgaatgcggggggaatcaatgagattgcattagcacctagtatgtatatgaaacagatggaacttacatttgaaaaaaatgttacaactccagaagatatggtattcatacaacataaagccactggcccggggtcaggtttacatgggattcattatgtgtctgtatttgattccagtacatcgtatcttcaattgatgtatccctccacggatgctaatcaatctatgtggaaaccgattcttccgtctgtagatatggattctaaatttatagatggcaattattttgcatttaaaaatgaaaatcttaatgtatttcttgcgtatcaaaacctaaatgagcgtcgtagctatgcacatgttggtactatgaattcaaaaacgatgtggcgtttaattccaatacaa

SEQ ID NO: 27 - DNA, 3675 bp, Bacillus thuringiensis
atgagtccaaataatcaaaatgaatatgaaattatagatgcgacaccttctacttctgtatccaatgattctaacagatacccttttgcgaatgagcccacaaatgcattacaaaatatgaattataaagagtatttaagtatgtccgagggctatgatagagaatattttgcttcacctggagcacttgttagtgggaaacaagcaattaaggttggaatcgatattgtcggcaaaatattaggggcgttagggattccatttgttggtgagatagttggtttttataattttattctcgatcagctatggccatcaaattctgtgagtatatgggaacagattatgaccctagtagaagaacttgtagatcaaaaaataacagaatatgcaagaaataaagcaatcgctgaattaacaggattaggaaatgctatggatgtatatcagcagtcacttgaagattgggtggcaaatcctaatgacgcaagaactagaagtgttgttgctactcaatttacagccttagaacttgattttgttcaagcaatcccatcatttgcaatatctgggcaagaggtaccattattaggagtatatgcacaggctgtgaacctgcacttattgttactaagggacgcttctatatttggggaagagtggggattctcatcatcagaaatttctcgatactataaccgtcaagtgcaactcacttctcaatattccgattattgcgtgaagtggtacaataccggtttacagaaattaaaaggtacgagcgctgagaattggctggagtatcatcaattccgcagagagatgactttcatggtattagatttggttgcattatttccaaactacaatacacacatgtatccacttgaaacaaaggctcaacttacacgagaggtatatacggatccgatcgcctttaatctttccggggcagcgggtttttgtagcccttggtcaaagtatactggtatttccttttcggagattgaaaatgctgtaattcgtccgcctcatttatttaatgtactcagaagtttagagattaatacagttagggggacaattttaggtaatactaaagacttccaaaactattggtcaggtcattctctacgatataattttataggtaatacaacaataagtgaaagtaattatggatatcttacttcagaaaaaactaggattgaattagacactagagatatttttgaaattaattcaactgccgcaaacttagcgaattactatcaacaggtttatggtgtgccacaatctgggttccatatggtgagatgggatagcccatataatacatcaactcaactttattctaaaacatatacaactccaaaagattgtacacaggtttatcaatcaagtgaggaaatacctgtagagagaaccgtaccggtaaatgaaggttatagtcacagactatcgtatgtcacctcttttgatttctctaaaattattaatagttttgttagaaatggaaatctacctgtatttgtttggacacatcgaagtgcagatcttacaaatacaatttatccagatgtaattactcaaataccagtggtaaaggcctatgcattgggtagctccatcttaccaggtagtccatcacctactattgtgccagggcctggatttacagggggggatataatacaattactggcgaatacaaagggtatagcatatatgaattttgaaattcaagacattaataaagaatatattatgagaattcggtatgcttccgctgcaaatcctgaattcaatatagctgttggtactagtggagaaagagttagtactagtgctcaaaaaactatgaatccaggggatattttaacatttaataaatttaattacgcaactttccctcccattaaatttaattcaactaaaatttcgatagcgttaacagcaagcttggctgcttttgcaagcacattattggaaacctatatagatagaatcgagttcattccagtagatgaaacatatgaagcggaggcagacttagaggcggcaaagaaagcagtgaatgctttgtttacgaatacaaaagatggattacgaccaggcgtaacggattatgaagtaaatcaagcggcaaacttagtggaatgcctatcggatgatttgtatccaaatgaaaaacgcttgttatttgatgcagtcagagaggcaaaacgactcagcgaggcacgtaacttactacaagatccagatttccaagagataaatggagaaaatggatggacggcaagtacgggagtcgagattatagaaggagatgctgtatttaaaggacgttatctacgcctaccaggtgcacgagaaattgatacggaaacgtatccaacgtatgtgtatcaaaaaattgaggaaggtgtattaaaaccatacacaagatatagattgagagggtttgtcggaagcagtcaaggcttggaaattttcacaattcgtcatcagacgaaccgaattgtaaaaaatgttccagatgatttattaccagatgtacctcctgtaaactctgatggtagaatcaatcgatgcagcgaacaaaagtatgtgaatagccgtttagaaggagaaagaggcttaccaaatgggaatcgctctgctgaagcgcatgaattctctctccctattgatataggagaattggattacaatgaaaatgcaggaatatgggttggatttaagattacggacccagagggatatgcaacactcggtaaccttgaattggtagaagagggaccattatcaggagacgcactagaacgcttgcaaagagaagaacaacagtggaagcttcaaatgacaaaaagacgtgaagagacggatagaaaatatatggcagcaaaacaagcggtagatcgtttatatgcagattaccaagatcaacaattgaatccaaacgtagaaattacggatattactgcagcccaagacctgatacaatccattccgtatgtatataatgaaatattcccagaaatacaagggatgaactatgcaaaatttacagagttatccaaccgactccaacgagcatggggtttgtatgatcaacgaaatgccataccaaatggagattttcgaaatggattaagtaattggaatacgacgcctggtgtggaggtacaacaaatcaacgatacgtctgtcttagtcattccaaactgggatgagcaagtttcgcaacagtttacagttcaaccgaaccaaagatatgtattacgagttactgcaagaaaagaaggggtaggaaatgggtatgtaagtatccgtgatggtggaaatcaaacagaaacgcttacgtttagtgcaagcgattatgatacaaataatgtatataatacgcaagcgtcgaatacaaatggatataacacaaataatgcgtacaatacgcaagtgtcgaatacaaatggatataacacaaataatgcgtataatacaaacggatataatacgcaagcgtcaaatacaaatggtttgtacaatgagcaaacaggatatatcacaaaaacagtgacattcatcccctatacagaacaagtgtggattgagatgagtgagaccgaaggtacgttttatatagaaagtgtcgaattgattgtggacgtagag

SEQ ID NO: 28 - DNA, 3267 bp, Bacillus thuringiensis
atgcaaccttcatctcagaataatcctgttccatatagtacatcaccagcctacacccaaacaaatcttcaattcatatcagacttagatcctactttaaacttctttaagaagcttaaaataggattaattaatggccaatatgtagaagttataatggaaatatgggagtctgttaagatgcacaagattaattatctatcatttgttgatttaagcatctccttaataactatatctgtgccccatgtaggaattaccgttccatttcttaatttgttcttttcggaatttacaggaaattattcagcattaccaatacccgatatttttacagcgattatatatgatacacaaaatatgtttaatcaaaatttaacaaccgatcaagaaaatttgaatactatgataaaagaatttaaacaaaatatggagaattataaaaaggaattagtaacacttgaagaaaattccgaagttttttttgataccttcgaccatacagataagctacttactgatactataaatcaatttatagtatcagactatactcaattgcatacaccttactttgctatctttgctactatacatcttatgatacatagggacgtaattatacacggaggaaaatgggggttttcagatatatttattcataaaaaaaggaataatataaaaaaattaattcaaaaatacctgttcattggatccaatttatttaaaaaggagttagataaccttttagcaagtcaaagtgaactcgaagtacatactcttccttcccatattcaaaaattccctttatatatccctaacatttatagattatggcctagtctagatcctaatatatatccaaactatacggaattagggaagactgaattattattagtgcatccaactgttataatagagtccaatttatttacaaataacattcatactaatgataatgagcttactagtatgaatgctaatatttcatcttacttaaattccattctaccagaagtcaataataaacatctacatatgtatgcaccccgagaaattccgtctgaaaatataataggaactattgatgtatgtccagacatccttccaatcaaaataacaagtttgtcaattgtaaattatgatgataatcaaggggaaactgtaacagaatggataaatggggggagtatagtaaaactccaatttaagcaagtagtgactgtttcttttataaatttatataatcacgcttatcagattcgtttacgttatgcaacagagtataacaaagaagctattatatgggtgtgtattcgggataatcagactggtaaaacccttttaaattcaaaactatcattttcagctccaacggattcaaattctatacaaggtgagtatggaaaatacattgtaaatataataatgaatggtgaacatgacactaaaaaaacaaccgtatatgcaggctcctatacgattttcataaaaaatctaatggaagaaaatctttttttagatcggcttgaattttgtaaaaaacctattaaaaacaatacattaatagtacttccaacaagagaattaaattctcctcctgcaggtggaattggatggactaatctctggattgcggaatgcaatcggataggaacggcttttgaagcagtaactgcagttgctgaaggtgagtacagattttattacaagggaaatttagtaggcgttattcagggaactacattttatgaaaacttcgatactgttcaaatttattttcataattgtgtagtgaatacgatcaatttgtttactggtgcaaatatttggacggaagatgattctcaggaatgttttaagaataatgaagacctaaaaaagattagaaaacaggtgaattctctatttatagaaaacctccataagaatttgaaacccgatattacagattattggatcgatcatgtggcattaaaagttgattcattatctgatgaaatttttggaaaggagaaaaaggaactacgtaagttaattaattatgcaaaacgcttaagtaaaactcgaaatttacttattggtggaaattttgaaaaactagataattggtatttgggaagaaaagtggtacgaattgaaggagagaaactatttaaaggatatcacatattaatcccaccacctattgagtatccatcatatgtatatcaaaaaattgatgaagataaattaaaagaaaatactagatatatcatttctggttttatcgcacaagcaaatcatttgaatatcgtggtgaatcgttacgggaatgaaatcaatcatgttcttaatgtattaaatatagatctcgtacctaccatacctgaagctttaacgaatagttgtatagcaaaaatcccacttacatttgataataaaagggatgtaagttctaatttttttagttacagtattcatgtcggttctttacaaaaacaagaaaatatagggattgaattggggcttcgtataacaaaacctacaggatttgctaaagtgaacaatattgaaatatatgaagaacgcccgttaacaaatcaagaaatacgtaaaataaagtatttagaggcgaaatggaaacattcgttcactcaatctgaatcaaatgtgatagcccaacttgaacctgtattgcagcaaattaatgcgttatatcaaaattcagattggaacaaatctattcgatcaactgttatgttccaggatgttcgagcaattaaattaccccatttacctaaacaaaaacattggtttatggaggatcgtactgatgtacatcatacaattatacaacagatgcaaacatccatacaatatgctttttcacaattaaacgaccgaaatatcctacagaatggaaactttacagatggattaataggatggatacctgatggaaatgtacaaattattttatcagaagaactaaataaagttatatctctttctcattgggatgcaagcattacacaattattagatattcctgactttaatccaaaccaagaataccaaatccgaatatacggaaaaggaaatgggactattatgatacaacacggaaataaaattgaagttatacatttttctagtaaagtattcatgtcaaaaccaagtcgttatatgactttcgaaacagctgctattgaactttatattgtatctgaaggaggcgaatttatcattgacaatattcagctaactaaaatacctctagaa

SEQ ID NO: 29 - DNA, 2016 bp, Bacillus thuringiensis
gtgaaaaatatgaattcatatcaaaataaaaataaaaatgaatatgagatattggatacttcacgaagcagctctactatgtctactcgttatcctaggtacccactagcagaaaatccacaaatatccatgcaaaatacgaattataaagactggataaatatgtgtgcatcaagaaatcttgaagatgggatttaccctacaagtgcaaatgatgtaattacaaattctattaatatttctagttatatactaagtatgttaggaatgcctaacttatcaagcatcatagctatatggggcgttctttttaatgcattttggcctgtttcaggtaatcaatgggaacactatatgaatcatgtacaagctcttattaagcgagaactacaggcttttgcaagagaacaagcacttagacaattagaaggattaggtggaaatttaggtttatataaagaggcattggcagaatgggagcaagaccgtgacaatccaactactaaagaaagggtaagagatcgattccgcatattggatggttttttcacccaatacattccagtttttagaatccaaggttatgaagtgcaattgttatctatatatgcaaaagttgtgaatctccatttacttttattacgtgatgctagtatgtttggggccgattgggggatgagccaaactaatattaatgataattataatcgacaaatgaaattgacttcattatacacaaatcattgcgttgatttttataatcagggtctaaatgaagctagagcgttatcaaattcaagttgggatatttttaatgattatcgtagagaaatgaccttaacagttttagatatagttgctctatttcctgcctatgattaccgtcgctatcctataactacaaaagtagaactcactagagagatatatacacctgcaattgcttctcagacttggagtaatcataatcatctgtcaccgaatgtgaattttcaattttatgaaaataaccttgtgcggcctcctgctttttttacttggctagatagaactgagatgttttctaggaacttaagtattgaagtttctgaagcttggggaggacatataaatcattttcatcacactggagaacaacctttatcttcacgtagtggtttcattggaagtgatcagcgccgagtctcatactatgatttcaatttcgttggtaatgatgtttttcgtatatattcaagagtaatgtcaaatcaagttggtaacttctttggagtaggacagggtgacttttttcttgtgaatagcgataattctaatactaaaacaatatcttttactactagagcaacgaattcaaatcaaagatccatattttctcaatttcctggtgaaaattcagacccaccaacttctaaggattatagccatagattatcatggatatcaggtgcatttattggtagcgatcttgcgaatgtgctttcatatggctggactcatagaagtgttgatcctaacaatactatttaccccgataggattactcaagttcccgctgttaaagccagtagcgctcccgactgcactgtaattctagggcctggatctacaggggggaatttggtaagtttcggaagaagcggaaggttgaatatgcaatttaaatttacaaatatacaaacagagtatcgtgttcgtatacgctatgcttctacagcggtaaatacactgtttgtttcatttagtgactataatcgggacatagcacttaattctacaggtgctttgtcactaaataatttgcgaaatgagaattttgcttacttcgaagttccgggaggcatttttagacctgctttaggtaatacattaatcatttcaaactggactactgttgctccgcgcttggtaatagataaaattgaattcatcccaattaatgccactactgcgagatatgggagcaagcaagagctagaaaaagccacaaaagtagtgaataacttatttataaat

SEQ ID NO: 30 - DNA, 1638 bp, Bacillus thuringiensis
gtggaaaatatgttcactaataatgcgaaaaatgcattaaaaatagaaacgacagattatgaaatagatcaagcggccatttctatagaatacatgtcagatgaacaatatccacaagaaaaaatgatgttatgggaagaaataaagcatgcaaaaaaacttagccagtctcgtaatttactagaaaatggggattttcaagattcttatgggtatgtgggaaataggtggacaaacagtaatagtattactattcaatctaatgatcctatttttaaaggacattatcttcatatgtctggggcaagagatattgatggaacgctatttccaacctatatctatcaaaaaatagatgaatttaaattaaaaccatatacacgttatcgagtaagaggatttgtgggaagtagtaaagatctaaaattagtggtaacacgctatgggaatgatattgatgccattatggatgttccaaatgatgtggcagatatgcaaccacgaccttcatgtggagattataatcgttgggaatcatcgtcccaatctgtgatgaactcagaatatcctacaccatatacagatggagaggcttccgatatgtattcatcccagtccaatcgaggtaaaaaacatgttacgtgtcacgattgtcatacatttgattttcatattgacacaggagaattagatacaaatacaaacgtaggtatttgggtcttatttaaaatttctactccagatggatacgctacattaggaaatctagaagtgattgaagaaggaccactaacaggcgaagcattggcacatgtgaaacgaaaggaaaagaaatggaatcaacacatggagaaaaaacgttgggaaacacaacaagcctatgatcgagcaaaacaggcagtagatacattattcacaaatgtacaaggagaagaattacaatatcatattactttagatcgtattaagaaagccgatcagttggtacagtcgattccctatgtacatcatgattgtttaccggatgttccaggtatgaacgatgatttatatacagatttaaatggacgtataacgcgagcacgttatttgtatgatgcacgaaacgtcataataaatggtgattttacactgggactaacgggatggcacgcatcaggacacgcggcggtacaacaagtggatggcgcttctgtattagctctatcaaattggagtgccggggtatctcaaaatctgcatgtgcaacatcatcatgggtatgtgttacgtgtgattgcgaaaaaagaaggactaggaaaagggtatgtaacaatgatggattgtaatgaaaatcaggaaacactaaagtacacttcttgtgaagaaggatatatgacaaaaatagtagaggtattcccgaaaagcgatcgtgtacgaatagaaattggcgaaaccgagggtacgttttatatacaaagcatcgagttgctttgtatgaaaggccatactagcaattataaccaaaatacgagtacgatgtatgagcaaggatatagtagcaactacaaccagaatactagcgatgtgtataatcaaaattataccaacaattacgaccagcattccaactgtacgtgtaatcaaggatataaccgt

SEQ ID NO: 31 - DNA, 3741 bp, Bacillus thuringiensis
atgaatcaaaattacaacaacaatgaatatgaaatgatgggtactggcggcatggactatcaaccaagatatcctcttacgaatgcaccaggttccgaattccaacaaatggattataaagattggatggatatgtgtactaatgagtcagtaggagacgtattcggtgacactgcgaacgctgttagggatggactcattattggtacaggtgttgcatgggcactccttggtcttattccagttgttggtggtgcagcatccgcaatagcaggactttttaatgtattgttgccatactggtggccagaacaagctggagcacctggaacgccccaagcacaattttcatggaatcagttgatgactgctgcagaagagatggtcgacaaaaagattctggagagtaaacgaggagaagccactgcaagatggcaaggtatacaactattagggagagactattattcggcgctctgtgattggatacatgaccaagacaatgcagggaagaaagaaaggttacgagatgcatttgatgacttagacgatcagttgaaacttgcgatgccattctttagtgtgcaaggatttgaacttcccatgttatctatgtatgcacaagctgctaatatgcacttgcttttgttacgagatgttgtccaaaatggggtgagttgggggtttgcgccatatgaggttgatcgctattatttcgatccaagtggccaaaggagcccagggttgttacaactcctaggcacttatacaaattactgtgtagaatggtatgagaaagggttacaggagcaatataacaccggtcgctgggataaattcaataatttccgtagaaatatgacaatcatggtacttgatacggtagcaatatggcccacattcgatccgagacgctatccactacccacaaaatcacaactgacacgaactttgtatacaaacccagtaggagaacgcctttatcgggaaaatatggattcgttggaaaacactctagttgctccaccacaattatttacatggttacgtgaaatcgaaatacctgttgggatagtgtatttggatgacagagctccgcttctttgtaaacagaccctccagaggactctgagttctacgacatggtcgataacgcagggagaaattacgactccagtaatagacacacttaccctgactattgaaccaccacattatcaggatgatgtctggaaagtgaacactcatggtatccgcggtaacactgataccgtaacgggatggacgttcaattttataaaatcgcctgatcaaactttaatggtttggaacaacatagctccgggttctgtgacggatagatggagtgggttcccttgtagaggtaatgattccgttatttgtgatccatgtgattttgagaacacttgtagaaaggaaacacctaacacgtctgttccttgcgatgataaacaacactatagtcaccgattgtcatatgtaggtgcccagggtgcaagcagacatgggttcaccccattcgagcttatgtggtttggttatggctggacccatgtaagtgcagataataacgtgctagatgagaaaaagattacccaaattccagcggtgaaaggataccatacaaatggtgctgtgataaagggtcctggtagtacaggagggaatttagtaaaactttctgaaaatgatgacctcaatataaatgttgcagtcttaccgccatctggctcagcattagtatacggatataacataagaattcgttatgcaagtagtgcagagactcggctccttgtcgagcaagtttctgaggaccatgggtcttatatatataatattccatctacgtcttctgctgatagtctaacatatcaatcttttagctactacgatttgccatttcatcgcattggtccaggaatagaagaaactccgacatcatctcgtctactttttcagaattcaggtgggggagatatcatcattgataaaatcgaattcattccaataaacacacctggggcagaatatgaagcgaatcaagctgtagaaaaagcaagaaaggcagtgaatgctttgtttacgaatgatgcaaagaatgccttacaactgaatgtcacagattacgcagtggatcaagccgctaatttggtagaatgtgtatcagaggaattccatgcacaagaaaaaatgatcctactggatcaagtcaagtttgcgaaacgtctaagtcaaacacgaaacctattaaactatggggattttgaatcctcagactggtcaggagagaatggatggagaaccagtcctcatgtccaagtggcatctgataatccaatttttaaagggcgttatctccacatgccaggtgcgaggagccctcaattttctaacaatacttatccaacgtatgcctatcaaaaagtggatgagtcaaaattaaaatcctatacacgttacctggtacgtggattcgtcgggaatagtaaagacctagaattattggtagaacgatacggaaaagacgtacacgttgagatggatgtaccaaatgatatccggtatacgttaccaatgaatgaatgtggtggccttgatcgatgcaaaccagcatcgtatcaggcaagacctcctcatacatgcacatgtaaagataccgctgtagcgcatacagattgtcagtgtaaagataaggggaatcgcacttcgacgaacatgtatacaaatgtggcaacaggtagtgaagtgtatacgaatggattccatgctcacaaatcttgtggatgcggtgacaaacacatggataagaacggaacacatccgtacaagtcttgtggatgcaaagacccgcatgtcttcacgtaccatattgacacaggatgcgtagatcaagaagaaaacttaggtctattctttgcattaaaaattgcgagtgaaaatggtatggcgaacattgataacctggaaatcatcgaagcccaaccattaacaggtgaagcattggctcgtgtgaaaaaacgagaacagaaatggagacaagaaatggcacaaaaacgtttagaaacagagaaagccgtacaaacagcgaaaggtgcgattcagaatctgttcacaaacgcgcagcaaaatcgtctgaaatttgaaacgctattccctcaaattgtccatgcagagaagctcgtagagcagattccctatgtgcatcacccattcttgagcggggcactgccagccgtaccaggcatgaatttcgatatattccaacaactattggcagtgatcggaaatgcccgtgcattatacgagcaacgaaaccttgtatcaaacggtacgtttggtgctggaatcgcaaactggaatgcgacagatggtgtgactgtacagccagagggtcctacatccgtactggttttatcaaattggagggacaaagcgttccaaaatctgcgcctcgatccagaccgtggatatgtcctacgtgtgacagcacgaaaagaaggcgcaggaaaaggcactgtgacgataagtgactatgcggcgtctccagaaaccctcacttttacatcttgtgacgagaacacaagcggtacgtttgtgacaaaaacgctggaaatctttccagacacagatagcatccgtattgacatcggtgaaacagaaggaacgttccgcgtagaaagtgtggaactgatttgtatgaaacagatggaggacaac

SEQ ID NO: 32 - DNA, 4221 bp, Bacillus thuringiensis
atgactgtcaggctctcagcccacaaactcaagcaatgcatactgatatatggggaacaaatccgagcaataacaagtatccccttcggaaggcaccaagttctgacttacgaaataatgaatttttcagagtggcaggatctatgtggaaatgtgagcccgcagaatcgaatagatatagatcctgaaactgcagtaactgcagctgcaggtatcggatgggctttactgggtatatcgaatccgatagcatccgcagtagcaggagtcgccaatgtacttattccgattctttggccaactgcagctgaagatccaaacgtgatatggaactccttgatggctaaggcagaagctctcgtagatgcgaaaatagatcaagcaatgaaggccctagcaatttctaaaataaatgggttaaaaaatgcgatgaatgaatattgtcgggcacttgccagattaaaggcggaccccaataacccaactgagaaagcggtagtacggggggcatatcagagcatggatttccttttcctatacagtatgcctcaattcgcggtgcctaattttgaagtacaattattgcctacctatgcggaagccgctaatcttcatctgcttttcatacgtgatgcggtcaagtttggaaacagctgggatatgacacaagctcaaattgagggagagtatactgatttaagaaatcacactagagagtacaccacccattgtgtaaattggtttaatactggtttaacaaggcttgaaacaaaaagcgccaacatgacggactgtaaaagatatccatgggctacttattatcaatatggttgggagtgcgcgctttctcctcgaacatgtcctactattcccctaaccagtacatgtgatgaacaaacaaatgaatattatccagaagaaaaacctgagacaaggggaaccggttaccgaggatctgagggcgaataccagggtctcgaaaattggaacctatataacgatttcagacgtgacatgacaattctcgtattagatatcgtatctgtatggccaacgtatgatccaagactatatcaattgggagtaaaatctgagcttacccgtacactgtatactccaatacgtggcacaacatatagaagtgatttaaatcaaaacacgcgtagtgcgatagagaatcgtatgattccgcagccaggtctctttacttggttaactcaactcaaatttgaaaggatcaatataccatataacggtactacatatggaagccagtacacagcaggagatcttctaactggtggatctcaacagcggaagtatactctatcttcgctatcttttgaaaaccagtttggacagacgggaacactaccgattataactgtaaatagtactcccgatagctctattacaaaactcattacgagacagtggtttgagccaagagaaattgagctttataaaggaaatgcatcccaatttaccttggggtcgatagtagagagatgcccttatctgatgggggaatctggatatactaaacaagtcatctatgatccaacacgtagagacaatatgataccaaaagcgatggatcccaataacccaagtgctccagcatcacaatggaaagattcacatcggttatcttatttcaaatatgaaccattacgtgctaattcgccttttgggtatcctgacaggggccaaataggggctgtgctcttcggatggacgcatatgctagtggatccgaataacacaatatcttcagatcaaatcacccgcattccagctgttaagggatataatagaagtacagatgcttcaataatcgagggaccaggttgtacaggaggaaatgtagcatcgctaagatcgcgggttactccggagggtagcatttttcagggtgttattctgattcgggtgaccggagtcacagcaaaagcgtatcgagtacgaatacgttatgcagcaagtcaaagtataacattaatattcgagagatacagatcctcgacgggggcggccgaattttctagacaagaaaccctttctccaacatattctggtacattaacatgtaactcttttggttaccatactataaatagtctacttccagctactgattttacattgtgggaattacaaatcaaaaatagaaccaacgcaaataccacaatcatcatcgacaaaatcgaatttattccaatcaatacgacgttagaagaatatgaagcaaatcaaaagttagaaaaggcaaggaaggtcgtaaatgctttgttatcagatgatgcaaaacagcgcttgaaaggaacgatacttggttcagatctggatattgccatgggattgattgaagacatcccatctgatcgatttcaaaaagaaacaatgattctacgggatcgtatcaaacaagcaaaacgtctcagtcagtctcgtaacctcttacactacggggattttgaatcaccagattggtcaggagagaatggctggacaatcagcaatgatgtgtctgtagaatctacgaattcgattctacaaggcaagtatctcaatctaccaagcgcccgtgatccactatctgatggtacagtctatccaacctatgtctatcaaaaagtagatgaatcgaaattaaagccatatacacgctattggatacgcggattgattggaagtagtcaggatttagagctgattgtgtcacgataccggaaagaagtacacaaaactctgaatgtgccagataaccaggatctgacgtcattacaaaaccgttttgaatcgttaagcggccctgaaattctggaacaagtacgagagaacttacaaggtatatcttgtggtccatattcatcacttgttcaaacaacagacaacaatggcgaacatccacatctattctcttgctacattgatgtaggtgatctggaccttgataacaatccagggatttcagttgctttcaaaattaattcagtggatggaggcgcacaaattcgtcatatcgaactggtagaaggcgcaacgttaacaagtgaagaaatcgcacggttgaaacgacaagagaagaaatggaaacaaaagaaagaacaaatgtgtgctcgggatcaagaagcgatccgtgcagcacaagcagcagttgaaaggttatttgtcagcccaacatgtggtcgcctgaagctggaaaccaaattacaagatattgtatatgctcaaacattggtaaatgcgattcctgatcgatataacccaatcctttcagaattacctggtgtcaatatggatatctttaatcaattgcaaaaccaactggaaatggcatacgggttatataatacgcgaaatgttgttgtcgatggtgactttatgagtggtcttgcgaactggaatgcgaccgaaggtgctgagatgcaacaaatcgatggtacatctgttgtggtaatttcagattggggtgtgaatgtatcacaagaactctgtgtgaatccagaacatgcctatctgttacgtgttaccgcaagaaaagaagggtctggaaaaggctatgtaacaatcagcgattgtacggaagacaacacagaaacaatgacatttatatccgatgaagagatactggaatctacccaatcacttcgtgatacgtctatagagacagctagtaggggagaaacgccatatgtaggtggtagcaataccatgaatgtgccatccaatcgttacacagaaaattcctacccaggtggtaataacatgaataatcagtatgtagaaaactcttatccaagtcatacaaacatgaattaccaatcagagagtttcggaattaatccatatggtgatcaaaatcagatgatgaattatcctaacaatacgaacatgacaaacgctcatgaagcgggttgtggatgtggttgtagtacaaacgcatactctggtgataatacgatgatgaatactccatctaacaatgatgaaatgaatgcatacccgagcgaaaacaacatgaatcactactcttcagaagcgtacggaacagaatcgtatccttctccaatgacagtacaaaatggttcttcactttctggttatgtaacgaaaacggttgaaatcttcccagaaacgaatcgtgtacgcattgaaataggggaaacagctggaacctttatggtggaaagtattgagttgattcgaatcggttgt

SEQ ID NO: 33 - DNA, 4116 bp, Bacillus thuringiensis
atgaatcaaaactatgaaaatggtgaaatggagatattagaatcaaacggaattcgctcaggattttcaatgggaaatatacaaaattctaatatatcaaacatgtccaatatgaggtacgaagagtggcaggatatgtgtgggacgaaaaaagaaggggaattattctcatatgcgacagggactcaggcagcttctgatatcacatgggccatattacacataggaaatccagctttttcagaggctgggggtattcatcgtacaatttctcctattctttggccgacagagacgcaagacccacaagctgtatggtcttctcttatagatagaggagagtatttgttacagaaaccgatagatgccaccctaaaatcacaagtgatcgcagaaataaatggtttcgaaacgttgtttaatcgatataatgacttcttgaatattttaaagcaaaatccaggtgatacagggttacaagaggctgtaaggttggcatttaattatataaatagccaactgttagagcgcatacctaaattttcggcaacaaattatgaagtacaattattacctgtctatacacaaattacaaatcttcatttgttgttattacgtgatgcagctaaattcggtaaaagttggggtatgagtgacgctgacatcaatacacatcaaagtagtttaacaacacaaacacgtatctacacagattattgtgtaagaacgtataataccgggttatccaatacgcctgcaccaaacttaaatgattgtacgagatatccatggctgcgttatgatcatccagatataacaggacctgttccggctaatccatgtacaggaagagaaagttcttgtgatgatgaacaaggaaatgaaaatctgcctgaagttagtccaagagcttggtatcgttcggcaaaagaggaatatgcgggtacagaaacatggaatttatataacgattttcggcgtgaaatgacgattatggtattagatttaatcgccttatggccgacctataatccactgacatacaatattccggtcaaacaagagctcacacgagaactctatacttccatacttggtactacctatcaaacagatcattcacagaatacaatcagtgcgatagataacaggatgacacgtcgccctcatctatttgaatggttaacaggtgacctaactgtggacgttcgacaaatgaatgctaattggataagaggttatttccaaacgaaggtgaagcaaagaaccaagcgtacattgggtagcacaattacagtccatgagagtgggaaacagggttcggactatcattattttccaaatgttactgctaatgaaagggattttcgagctttcgatacgaacgtttggtttgaacctagattgtttcggatgtattttgctgataagtggtattatccctcttgggacgtaaacgttttggaaactgagccttggtctccagaaggccctaaaacacatgcttatcaaccaacaattagaagtagtattaatcgtcatcgtgtgtcattttggatgtggcagtctgtacgttccaatgcaccttttactagatggaatgaagggcaattaagtgctctcaactgggcatggacacatgatagtgcagatccaaataatacccttgctgcagataaaattacccgtattccggcagttaaggcctttcagataaaacagggtgcacaggttataaaaggacctggttttacaggcggtgatgtaatcactatgccttctagttctcatggagcaaaaacgcaaatagaaatgaatgttaagccacaacaaacaggaaaaccttatcgagttagggttcgttacgcaagtcagcaatctggtgaaatattcgtaggaaaatgggttgaaaaatggttcgaaaaaggttggtatagtattcctgctacatattctggagagttaacacagagctctttcagatatttagacactattcaatttactgcaaatgaatctcaatttgggatagatctccaagctggcatagggggagcggtcattattgacacagttgaattcattccactaaatacgacattagaagaatatgaagttaaccaaaaactagaaagggcaagaaaggtcgtgaacaccttgtttacggataatgcaaaccagcgattgaaaggaaaggtacttggttccgatctggatattgctatgggattgatcgaagacatcccctctgatcgttttcaaaaagaaagaatgatcctacgggatcgtatcaaacaggccaaacgtctcagtcaatctcgaaacctcttacgatacggggattttgaatcaccagattggtctggagagaatggatggacgatcagcaacggtgtttcagtggaatctacaaattcggttctaaaagggaactatctcaacctaccaaacgctcgtgatccgctgtctgatggtacaatttacccttcctatgtctatcaaaaggtagatgaatcgaaattaaagccatatacacgctattggatacgtggattgattggaagtagtcaggatttagagctgattgtgtcacgataccggaaagaggtacacaaaactctgaatgtgctagataacctggatctgacatcattacagaaccgttttgaatcgttaaacggccctcaaattctggaacaagtacgagagaacttacaaggtatgtcttgtggtccatactcatcacttcttcaaacgacaggaaatacgggggaagacccacatatcttctcttgccacattgatgtaggagagctggacctgggttgtaatccaggaatcgaggttgctttaaaaattaatacagtagatggaggcgcacagattcgtcacattgaactcatagaaggagcaccgttaacaagtgaagaaatcgctcgagtaaaacgacaagaaaagaaatggaagcaaaagagaacgcagatatttacccgggaccaaggtgcaattcaaacggcacaagaagcgattaaccgattatttgtgagtccaacatgcggtcgtctgaagctgacaacaacactgcaagatattgcatatgcacagacattggtgaatgcgattccggatcgatataatcagattgtttcggaattaccaggtgtgaatatggatatctttggtcgcttgcaaaaccaactggaaatggcatacgggttatataatacgcgaaatgttgttgtcgatggtgactttatgagtggtcttgcgaactggaatgcgaccgaaggtgctgagatgcaacaaatcgatggtacatctgttgtggtaatttcagattggggtgcgaatgtatcacaagaactctgtgtgaatccagaacatgcctatctgttacgtgttaccgcaagaaaagaagggtctggaaaaggctatgtaacaatcagcgattgtacggaagacaacacagaaacaatgacatttatatccgatgaagagatactggaatctacccaatcacttcgtgatacgtctatagagacagcgagtacgggagaaacgccatatgtaggtggtagcaataccatgaatgtgccatccaatcgttacacaggaaattcttacccaggtggtaataacatgaataaccagtatgtagaaaactcttatccaagtcagacgaacatgaattatcaatcagagagtttcggaattaatccatatggtgatcaaaatcagatgatgaattatcctaacaatgatgaaatgaatgcataccctaacaatacgaacatgacaaatgctcatgaagcgagttgtggatgcggttgtagcacaaacgcatattctggtgatcaaaatcagatgatgaattatcctaacaatgatgaaatgaatgcatacccgagcgaaaacaacatgaatcactactctgcagaagcgtacggaacagaatcgtatccttctccaatgacagtacaaaatggttcttcactttctggttatgtaacgaaaacggttgaaatcttcccagaaacgaatcgtgtccgcattgaaatgggagaaacagctggaacatttatggtggaaagtattgaattgatccgaatcgattgt

SEQ ID NO: 34 - DNA, 2910 bp, Bacillus thuringiensis
atgaatcaaaattacggtagtaatgaagtggaaatactaaatagcagaaatatgagttgccagccaaggtatccgtttgcgaaggctccaggttcggaatttcaacagatgaattacaaagattggatggatatgtataacaatgagagtcaggctttcatgggagagagatacaacagctctataagagattcaattattacatctacaaacattattgcttacctcctttccgtttcttttccaggcgctggagcagccgtagggattataggagcactgcttggtctactttggcctacaaattcacaaaccgtttgggaagcttttatgaatgcggtagaaagtctaatcaatcaaagaattcaagatacggtacgtgaaaaagctattgctgaattagaaggtcttcaaaatgttttagaattatatcaggaggcatttgatgattggagtgaaaaccccagccaacaaaaccgttatcgggtattaactgagtttcgtggtgcaaataggacattcgaggcagctatgccatcctttcgttttggcgactttaaggtggaattactaactgtgtatgcacaagctgccaatctacatctactcctattaagtgagggggttaaatttggaagagattggggaatgtcttccttacctggtgaagaatggtcagatatatatagtaggcttcaaagacgtacacaagagtatacagattactgtgtgactacgtacaatgaagggtttgataaggcaaaaatgttagtagccaatctatgtgatttaaacagatatccatgggatcgttataatcaagagttcagagcatctgaccatccaaattgtggtgcgagatcattatatataggggatcaactacaacatgaatgtaatgaacaaatgaatctatatagggcaagcatccgtcgatcattagatgaatacaggggattagagaattggaatttatttaatgcttttagaagagatatgacaattatggtactggatattgtagcaatgtggccaacatatgattcagttttatacgataatccgtatggtataaagtcagaaatcacaagagaagtatatacagatatacgagggacaacgtatagaagtgataactctcaaaatactatagttgccatcgaagggcgtatgataccacaacctaggttatttagatggttaaatcagtttagattttattggaggcgacttagtggggattatactgctggacaaattattactggcttgcagataaccgtacaaacaactttaggttcttccgaaacattgcccttagctggttatggaggaacgtctactacaacttggcatccctcatatggtattacttggatagataccaagcagtggtttgaaccgagatggatgcgattttggagtggcagttatgacgcagggtggacagatcatggaacagtaggaacgatagaagaaaagcatcctttttgggctgcgggaccgcaacagtacgtttataacccctcacaaagagcaaatgaaattccgaaacatcgattatcgtggatgaagtatgagccaattagatcgaattcaccttttggttggacggaatatcaacagttaggtgctcttactttaggatggacgtataatagtgtagatcctaataatacaatatcttcagataaaatcacccaaattcccgctgtaaaaggaaacgcagtagataacggtgccacagttgtcagaggacctggtagcacaggaggcgatcttgtaaaattacctgcatataatcagcaagggacacaattacgtgttaaagtaagaccgtccactactgcccgaacaagacgatataacgtacgcatacgatatgctagtgaagcgaatgcaaatctatttgtagggaagtatgtggatgcggcaaatagatggtatgagactggaaactatgctgttaaccaaacgttttctggaagtatgacttataacgctttcaaatacttagatacaatcagttttctagcaaatgaagaagaattcaaaatagaactacgttgtaatagtggaggccctatctacatcgataaaatcgaatttattccggtaagtccgattggagaaggagaaataccagaaccaccagcaccactactttcctatacttatcaaattattacgtcgttaaatgatcgtagcgtcgtggatctgaatcaatcaaacaacaatgttaccttatggaacaataatggcggcaataatcaaaaatggaaatttgtatataatccgagcacaagagaatatcaaattaaaaatttagcaaatgaaaatttagtattgacttggaatgactctgggggatcaaataatgtggttgctgcaactaatcaacaattagatacgcaatattggatagctgcagaggcaggtaatggctatgtgtatttgaaaaataagagagaccagaataaagtattggatgtaagtgattctaatactacgaatggaacaaatattatagtatataatttcaatagtggtaataatcaaaaatttagattggctgatgttgcaggaacattagcagcacaggtagaatcactctatcgtgcgcagcctggtcaaagcagcagatcaagtgataatttttcacttggacatcttgctgctggttccatagtacatgttgtcttagaaggcgcaggtgctacagctatttcatttaatatttcaaaagacatacgtaatggttcagaccgcagaatttggtcagatgtaagggatggttctactctaagagttccttcgggagatgatagaaataatttgtatatttcaggtcctcctaggggatatacttctaacggaacatttacagtgaaattctacgctgtttcaacc

SEQ ID NO: 35 - DNA, 2082 bp, Bacillus thuringiensis
atgaattccaatgtgacaaaagcgcgtgaggccgttcaagccttgttttcgaatccaactacgttacaattgaaagtcacggactatcatgtggatcaggtggcaaggttagtagagtgtatagcagatcaaatccatccaaaagaaaaaatgtgtttgctgaatcaagtgaaattggcgaaacgtttgagtcgagaacggaatctattaaactatggagactttgaatcatcggattgggttggcacagatggatggaacgtaagcacccatgtatacacggtagctgataatccaatctttaaaggtcattatctcaatatgccgagtgcgaataatcccatattgagtgataaaatatttccaacttatgcctatcaaaaggtagaggaagcaaaattaaacccatatacccgctacatggtacgaggatttgtaggcaatagtacagatttagaaatactcatcgcgagatatgataaagaagtgcataagaaaatgaatgtaccaaatgatatcataccaaccaatccatgtacaggagaacctgtatcacagccaacaccgtatcctgttatgccaagtaatacgatgccacaagacatgtggtgtaatccatgcgagaatggatatccgaatgcagcagggatgatggttcaagagacaaatagggtgtgtcaagatccacatgaatttaagtttcatattgatataggggaactagatatggaacggaatttaggcatttggattggttttaaagtgggaacaacagagggtatggcgacactagataatatagaagtagtagaagtagggccactaacgggagatgccttaactcgcatgcaaaaacgagagcccaaatggaagaaaaaatgggccgagaaacaaatgaagattgaaacggctgtgcaaacagcacgaaatgcgattcaaacattattcacagaaccaaatcaaaacagactacaatccgctatcacactgaaacatattgtagatgcagaaaaatgggtgcaaaagattccgtatgtatacaatcaattcttgcaaggagctatatcaggaataccggatgaagcgtatgcgtatgatattttccaacaactttcccaagcagtggtgacagcacgggggctgtataatcagcgaaatgtgataaacaatggggatttcactgggggattgtcaaactggaatgcgacagagggtgcagatgtacaacagattggagatgaatctgtgctggtgatttcagactggagtgcaagtttttcccaacaggtgtatgtggagccagaacatagctatttattgcgtgtaacggcaagaaaagaaggttctggtgaaggatatgtgacaattagcgatggaacgaaagacaatacagagacaatgaagtttatagtcgatgaagagacgacaggtgcgacaatgtctcctattcgtgaacgctataatgaacgtaatatggcgactccagaagcgtatggagcaagtggatatgcgagcgttcaaaataatatgaattacccatcagaaaattatgaaatggatgcatatccaggaaataacagcatgaattatcagtcagaaagctttggatttactccatatggtgatgaaaatagtaggatgaactatccatcagaaaattatggtgaaaatgcatatgcaggcaacaacaatatgtatcattcatccaacgattacgaaatgagtgcatactctagtcaaaacaatatgtcaatgagtcaagaatcggattgcggatgtggatgcaacaaaaatgcatatccgagtgaaaatatgatgatgaataattattcgtctagcacatatgaaatgaatacgtaccctagcagcacgaacatgaccaataatcaggggatgggttgtgggtgccattatagcgccgatgagtatccgatggtagagcaaagtacttctgaactttctggttatgtaacgaaaacagttgaaatcttcccagaaacgaatcgtgtttgcattgaaatgggagaaacagctggcacatttatggtggaaagtatcgaattgatccgaatggattgcgaa

SEQ ID NO: 36 - DNA, 3468 bp, Bacillus thuringiensis
atgaatcgaaataatcaaaatgaatgtgaaattattgatgcccctcattgtggatgtccgtcagatgatgttgtgaaatatcctttggcaagtgacccaaatgcagcgttacaaaatatgaactataaagattatttacaaacgtatgatggagactatacagattctcttattaatcctaacttatctattaatactagggatgtactacaaacaggtattactattgtgggaagaatactagggtttttaggtgttccatttgcggggcaactagttactttctatacctttctcttaaatcagttatggccaactaatgataatgcagtatgggaagcttttatggaacaaatagaagggattatcgctcaaagaatatcggagcaagtagtaaggaatgcgcttgatgccttaactggaatacacgattattatgaggaatatttagcggcattagaggagtggctggaaagaccgagcggcgcaagggctaacttagcttttcagaggtttgaaaatctacatcaattatttgtaagtcagatgccaagttttggtagtggtcctggtagtgaaagagatgcggtagcattgctgacagtatatgcacaagcagcgaatctccatttgttgttattaaaagatgcagaaatttatggggcgagatggggacttcaacaaggccaaattaatttatattttaatgctcaacaagatcgcactcgaatttataccaatcattgtgtggcaacatataatagaggattaggagacttaagaggcacaaatactgaaagttggttaaattaccatcaattccgtagagagatgacattaatggcaatggatttagtggcattattcccatactataatttacgacaatatccaaacggggcaaaccctcagcttacacgtgatgtatatacagatccgattgtatttaatccatcagctaatgtaggattatgtagacgttggggcaataacccatataatacattttcggaacttgaaaatgccttcattcgcccgccacatttttttgataggttgaatagtttaacaattagtagaaatagatttgacgttggatcaaactttatagagccttggtctggacatacgttacgccgtagttttctgaacacttcggcagtacaagaagatagttatggccaaattactaatcaaagaacaacaattaatctaccagctaatggaactgggcgagtggagtcaacagcagtagattttcgtagcgcgcttgtggggatatacggcgttaatagagcttcttttattcccggtggtgtgtttaatggcacgactcaaccttctactggaggatgtagagatttgtatgattcaagtgatgaattaccaccagaagaaagtagtggaacgtttgaacataggttatctcatgttacctttttaagttttacaactaatcaggctggatccatagccaatgcagggcgcgtccctacttatgtctggacccatcgagatgtggaccttaataacacgattactgcagatagaattacacacttaccattgataaaatcaaatgtgcaacgcagtggtcgcgcagtaaaaggaccaggatttacaggaggagatgtactccgaatgtcatcaagtgatgctgatatatcaataataggaataacggcaggtgcaccgctaacacaacaatatcgtataagattgcgttatgcttcaaatgtagatgttactatccgtttagtgagacaggacacccaaagtaatataggaagcataaacttattacgtacaatgaacagtggagaggagtcaaggtatgaatcatatcgtactgtagagatgcctggtaattttagaatgactagtagttcagcacagattcgactatttactcaaggacttcgagtgaatggagaattgtttcttgatagtcttgaatttatcccagttaatccgacacgtgaggcggaagaggatttagaagcagcgaagaaagcggtgacgagcttgtttacacgtacaagtgatggattacagataaatgtgacagattaccaagtcgatcaggcggcaaatttagtgtcgtgcttatcagatgaacaatatgggcatgataaaaagatgttattggaagccgtacgcgcagcaaaacgcctcagccgcgaacgcaacttacttcaagatccagattttaatacaatcaatagtacagaagaaaatggctggaaggcaagtaacggtgttactattagcgagggcggtccattctttaaaggtcgtgcacttcagttagcaagcgcaagagaaaattatccaacatacatttatcaaaaagtagatgcatcggtgttaaagccttatacacgctatagactagatggatttgtgaagagtagtcaagatttagaaattgatctcatccaccatcataaagtccatcttgtaaaaaatgtaccagataatttagtatctgatacttactcagatggttcttgcagcggaatcaaccgttgtgatgaacagcagcaggtagatatgcagctagatgcggagcatcatccaatggattgctgtgaagtggctcaaacacatgagttttcttcctatattaatacaggggatctaaatgcaagtgtagatcagggcatttgggttgtattaaaagttcgaacaacagatgggtatgcgacgttaggaaatcttgaattggtagaggttgggccattatcgggtgaatctctagaacgcgaacaaagagataatgcgaaatggaatgcagagctaggaagaaagcgtgcagaaacagatcgcgtgtatctagctgcgaaacaagcaattaatcatctatttgtagactatcaagatcaacaattaaatccagaaattgggctagcggaaataaatgaagcttcaaatcttgtgaagtcaatttcgggtgtatatagtgatacactattacagattcctggaattaactacgaaatttacacagagttatccgatcgattacaacaagcatcgtatctgtatacgtctcgaaatgccgtgcaaaatggagactttaacagtggtctagatagttggaatgcaacaacagatgcatcggttcagcaagatggcagtacacatttcttagttctttcgcattgggatgcacaagtttcccaacaaatgagagtaaatttgaattgtaagtatgttttacgtgtaacagcaaaaaaagtaggaggcggagatggatacgtcacaatccgagatggcgctcatcaccaagaaactcttacatttaatgcatgtgactacgatgtaaatggtacgtatgtcaatgacaattcgtacataacaaaagaagtggtattctacccagagacaaaacatatgtgggtagaggtgagtgaatccgaaggttcattctatatagacagtattgagtttattgaaacacaagag

SEQ ID NO: 37 - DNA, 3480 bp, Bacillus thuringiensis
atgaattgtggaaaccataatgaatttgatagtatagatgagactgaaaacaatcagactacaacatcaagatatgttaatgtaacaaacaaagtaactaaacaagggaattcatctaataagattctttctaatctatcttctaattatcctctagcaagcaatccaaatacaccatttcaaaatatgaattataaagagtatctgaatattattgaagggaatactgttattagcccgactgttggggtggcgagtgctttaacagctggggtgaccattttaaataaaatccttggtactttactaaagaaatttgcaggaaaaattttggtgaatattttcaagcttttatggccgactgcagaaacagacgatgtatgggaagattttatggaagaagtagaaatattgattgatcaaaaaatagaggcatatgcaaaaagtagggcacttacagatttggtatcaataggtaatgctgtagaaagatatcaaactgcattagaagattgggaaaaacaacctgaaaatttaaaatctctaggacttgtaatacaaagatataatgaagcggaaagtcatgctcgaaatagcatgccattatttgcggttggtggttttgaagtgcctctgttagcaacgtatgtaaatgctgcaaatgttcatttgctgttaatgagagatatgcaattatatggaaatcaatggggtattcctcaaagtgatatagacctttatcaaagagaacaagaaaagtatactgatgaatatacaaattattgcgtgaaatggtatgaagaaggattaaagcttttagaccctagagaaaattcaagtcttcaaagttttgcttatcagtgggagttttataatcgttatcgtagagaaatgacattaatggtattggatctgatttccgtatttccaagttataatgcagttctatatcctatagggacaacagtaaagattacaagagaagtttatacggatgtgatggcctatgatgagtggtaccccgaagaggtagtttcgtcttttacggatttcgaatctattttaattcgtccgccgcatttatatgatcttttagaacgtattgacttttatactaatgttcaaggggatagctatcgctgggctggtcataaaataacttataaacgtggaccgtatgaaactgcgcatactaaatcttatggtgacactgcaggtacccctacagatatttactttggatacagtgatgttgttagcactataacaaaagccacccgtacagtttatggagttgttaaatcgacgttttatcaagtaaatggggaaaaaagagagtacgatgcaaattcagtaggtaattatagagaagcaatatatgattcaaataatgaattgcctctaggaacaagtggcaatttggatgatgataggagccataaattatgtcatgctgtgttgtacaaaaaagacaaatcgcctactgcttatgttatatattcttggacacatgcaagtgcaggcagaataaatgaggtttttggagataaaatttcgcaacttccggcggttaaaatgtatgacctaggaggatcaaccactgttgtaaaaggccctaaatttacaggtggagatttagttaagagaaaggcgagtagtggtggtggtgtccttggatattataaatgtaatgttgcctcatctgatgctcagaagtatcgcttgagaattcgttattgttcagattttagtggaatatttcgtatgcaagttaacggagtagaaactattcaggcggattatagtagtactcgtgattcaacaagtactatgtcaagcgaatcatttaaatttagagaattcaccactactttcgagttatccgaaggtactccatcgataatggtagctttaggttctatttatggtgaaggagaattttatttagatagaattgaattcattccagtggacgtgaattatgatgaaagagtaacattagaaaaagcacaaaaatccgtgaatgccttgtttacagcgggaagaaatgcactccaaacggatatgacagattttaaagtggatcaggtttcaattttagtggattgtgtatcaggggagttatatccaaatgagaaacgcgaactactaagtttagtcaaatatgcaaaacgtttgagctattctcgtaatttactcctagatccaacattggattctatcaattcatccgaggagaatggctggtatggaagtaatggtattacaattggaaatggggattttgtattcaaagggaactatttaattttctcagggaccaatgatacacaatatccaacgtatctctatcaaaaaatagatgagtccaagttaaaagaatatacacgctataaactgagaggttttatcgagagtagtcaggatttagaagcatatgtgattcgctatgatgcaaaacatcaaacaatggatgtatccaataatctcttaccagatacttctcctgtgaatgcatgtggagaaccaaatcgttgtgcgggactacaatatctggatgaaaatccaagattagaatgtagttcgatacaagatggtattttatctgactcacattcgttttctctcaatatagatacaggatctattgatctcaatgagaacataggtatttgggtgttatttaaaatttccacatcggaagggtatgcgaaatttggaaacctagaagtgattgaagatggtccagtcattggagaagcattagcccgtgtaaaacgcaaagaaacgaagtggagaaacaagttggcacaactgagaacggaaacacaagcgatttatacacgcgcaaaacaagcgctggataatttatttgcaaatgcacaagactctcacttgaaaataggtactacatttgcgacaattgtgtctgtacgggagattgtacaatcgatacgtgaagcgtatatgtcttggctatctgtcgtcccaggtgtaaattatcccatttttacagagttgaatgagagagtacagcaagcattccaattatatgatgtacgaaatgtcgtgcgtaacggccggttccttaatggaatatctgattggattgtaacatctgacgtaagggtacaagaagaaaatgggaataatgtattagttctttctaattgggatgcgcaagtattacaatgtctgaagctctatcaagaccgcggatatatcttacgtgtaacggcacgtaagataggattgggagaaggatatatcacgattacggatgaagaagggcatacagatcaattaacatttggttcatgcgaaagtatagattcatccaattctttagtatctacaggctatattacaaaagaactagaattcttcccagatacagagaaagtgcatatagaaataggagaaacagaaggaacattccaggtggaaagtgtcgaattattcttgatggaagatctatgt

SEQ ID NO: 38 - DNA, 3765 bp, Bacillus thuringiensis
atgaacctaaatgataacaagaatgaatttgaaatcatggatcatggtagcatgggctatcagcccaaatatccccttgccaaggaatccgttcctacagggcaaaatatgaattacacagattggatgaatcggtgtgcaaatggggaagtagacgtattcggtgatacttcaggcagtgttaggaatgcccttatttacggtacaggtgtagggtgggcactccttggtttcattccagtcattggtggaccagcatccgcaatagcaggactttttaatgtattgcttccctactggtggccagaacaagcaggcgcgtctggatcgccccaagcacaatatacatgggctcagttgatggctggttcagaagagattaccgacaaaaaaattctggagagtaaaaaatcagacgcaattgccagatggcaaggtatacaaagtatgggacgtgtatattatgaaaagctatgcgactggataggagatcaaaacaacgaagtaaaaaaagacagattacgagatgcatttgatgacctcgacgatcgaattagagtgtctatgccacatttccaggcacaaacatttgaagttcaaatgttatccatgtatgcgcaagctgcgaatatgcacttactcttgttacgagacgttgttacaaatggtacaaattggggatttgagcaattcgaggttgatcgatactattccaatgcagatggcctagggaatccagggttactacaactattaaacagctatacaaactattgtatcgattggtataataccggtttacaggagcaatatgacactggtgactggaataaattcaataattttcgtacaaccatgacaatatcggtacttgatactgtagcaacatggccaacatttgatcccaaattctattcgttacctacaaaatcacaactgacacgaattgtgtataccccaagagtaggagacacagcaaggtctaatagaccatctgcatctatagatgcgcaagaaaataatatagtttctagtccacgtttattcgcctggttacgtatggtggatgtatctctgcagaagaatggtctttctaatgagatagcatcgtataaacaaactttccacaatactttacgtactggctcatggtcgataactaagggaacacctactaacgatgtacgtaatatgtttacaataccatattttccttatgatgatatctggaaaattaaaaatgaatttttcgattatggttctccattcgatgatctggctgtagatagctggacgttttctttcagatactcagaggatcaatattttgagctgagtacgtatgataaatcggtcactcgcttctatgggttaccttgtagagccaagaattccggtatttgtgacccctgtgatagtcagaatccttgtagaaaagagctccctaacacgactatgccttgtgaagataaacgactatatagtcatcgattggcctatatgggtgcgggtgaaaatgtttatccccccccaagcttaacctattctgcttatggctggacacatgtaagcgcagatgcagacaatcggattgatgctgaaaagatcacccaaatcccggcagttaaggggaatgagttagagggaggaactgtaataaaaggacctggcagcacaggtggaaatttaatacagttggattcatatggtaatcgtatagtactacctataaaactacctgtaacgactcaggcatatcgtgtaagaatacgttatgcaagtaatgcggttctatctatacgtgtttctctggacggcgacgttgttctcggtacctttattgccccagcaacgactagcgatttaacaaaactcacatataatacatttgcctacctagatacctcggtacttacggcagaacggtctactcgattgatgtttatttctcataatgacttgaggaattcaagaaccttcatcatcgataaaatcgaatttatcccaattgaaggatcagcggcagaatatgaagctagtcaagctgtagaaaaggcacgaaaggcagtgaacaccttgtttacgagtgatgcgaaaaacaccctaaaattgaatgtgacggattacgcagtggaccaagctgccaaccttgtggagtgtgtatcagaagaatttcatgcccaagaaaaaatgattatgctagatcaagtcaagtttgcgaaacgactgagtcatgcacggaatctattacactatggagattttgaatcctccgattggtcgggagagaatggatggagaaccagtcctcatgtccatgtggcatctgataatccaatctttaaagggcgctatctccacatgcctagtgcgacgagccctcaattctctaacaatatctatccaacgtatgcctatcaaaaagtggatgagtcaaaattaaaatcctatacccgttacctggtacgtggattcgtcgggaatagtaaagacctagaattactggtagaacgttacggaaaagaagtacatgtcgagatggatgtaccaaatgatatgcaatatacgttaccaatgaatgaatgtggtggctttgaccgatgtcaaccagtctcctatcaggaaagaccccttcatacatgcaaatgtaaagataccgctgtagcgcatacagattgtaagtgtaaagataaggaaagtcgtacttcgacgaataggtatacatttgagccaacaggtaatgcggtatatatgaatggatctgatcacaaatcatgtggatgcaagaaccacgacatgtatcagaacggaacacatccgcataagtcttgtggatgcaaagatccacatgttttctccttccacattgacacgggatgtgtggacatggaagagaacttaggtctattgtttgctttaaaaattgcgagcgaaaagggtgtcgcaaacattgataacctggaaatcattgaagcacagccgctaacaggggaagcattggctcgtgtgaaaaaacgcgaacagaaatggaaacaagaaatggcgcaaaaacgtttacaaacagagaaagccgtacaagcagcgacaggtgtgatgcagactctattcacaaacgcgcagtacaatcgtctcaaatttgaaacactgttcccgcacattcttcatgcagagaaactcgtacaacagattccatatgtgtaccatccattcttgagcggggcactgccaactgtaccaggtatgaattttgaaatcgtccaacaatttttggtagggatcgcaaatgcccgtgcactatacgagcaacgaaatctcgtgcataatggtacattcagctcaggtacaggaagttggaaagtgacagaaggtgtagaggtgcagccacttcaagacacatctgttcttgttctatccgaatggagtcatgaagcgtctcagcagttacacgttgactcagatcgcggatatgtattacgtgtaactgcgcgaaaagaaggcagcggaaaagggactgtaacaatgagtgattgtgcagactacacagaaacactgacctttacatcttgtgactataatacggttggtatccaaacgatgaccgaaagtacgttatcgggatttgtgacaaaaacgttggaatttttcccagaaacagatcgtattcgcattgatattggggaaaccgaaggtacgttccaagtagaaagtgtggaactcatttgcatggaccagatggaagatgcaggtaactttgaagacgagatg

SEQ ID NO: 39 - DNA, 3858 bp, Bacillus thuringiensis
atgaatcagaattacaataaccatgaatatgaaatcaaagatgctggtatcatagacgatcagccacggtatcctcttgcgcaggctcctagtgctgaagtgcaacaaatgagttataagggttggatggataggtgtacaaatgaggagtcagaagcattgttcacagacattactgttaaggatgcagtcaccatagctacaagtattacagcagcagttcttggtatttcatttccattatcagcagcaacagcaagtattgtatctgtattgattccatactggtggccggcggcagcaggaactcctggttctacccaggcgcaaattacatgggaacgattgatgagtgctgtagaaaagctcagtaatcaaaaaattcaagatagtaaacgatcggatgccatttccagatggaaaggaatacaagcgttaggacgcgaatatgcccgtgcactttgtgatttaaaagaagaacctgataatgcagctctaaaaactacagtgagaaataagtttgaaagtgtggaagatcagctgaaaatttcgatgccctacttttctgcagaagggtttgaaattccaatgttatccatgtatgcacaagctgctaatatgcacttgcttttattaaaagatgttgtccaaaatggtgtgagttggggatacaggcaaatagacgttgaccgatattattctaatacagacccttttctggggaaccctggattattgcaactatcagctacttatacagattattgtgtacaatggtataacactggtttacgacaacaatacgcaattaatagtaataattggaatgtatttaatgcgttccgtagaaatatgaccataatggtattagatattgtatctttatggccaacttatgatccaaaacgctattctctacctacaaaatcacaacttacacgaactgtgtataccgatttattgggtttttctggacatgatgcgtacccacaaataggcattgaaagagcagaattggaactagttcagagacctggtctatttacctggctgcgcgagctaaatttcaacctgaagtcacagtcgctaataaactttgtagcaggaatagaaatggacttcgattataccacagtttccgaagggtataaagagaaagaggggagtcttggacaaactcgagagactgttgttcttccatcgaagtattcacaggatgacatctggaagatcactacttcacttaatttaaatcaaataccaaatgctaatgccgttaagggctggattttttcttttactaaatcaccagaccaactagtatcttggggtccagcagaaagtgatggagacaaggtacactccggattagcgtgtaacgggccttcggtggattcttgtgacctttgtataatcgatagtccgtgtcgatcgattactcctaacaatagcttcccttgtgatgacaagggtgtttatagtcatcgattttcatatctaggggctggatttacaccggatgtttcagcattaagcttttttagctacggctggacccatgtaagcgtagatgcaaacaacctgattaatactggaaatatcacccaaatcccagcagtgaaaggatctttttcagaaggaactgtaatacgaggacctggtagcacaggaggcgatttagtacaattatttccttctcagcttctgcatttacgtgtgacgattcctgcagatccgctaacagggtatagaatcagaattcgttatgcgagtaaagtgcccgctgaaatcgctgtgggtttccaaagttcgcttggggagcctgatgccacgtatcaagttccggctacttatactagtggtgatctaacatataatacctttggatatcaaaacactttaagtatacccccacattcagaagaagaactcatttatgtaatagtcaatactgtaaattccatcgactccgaacccgtcattatcgataaaattgaattcattcccattgaagaatcagtggcagaatttgaagcgaatcagggtatagaaaaagcaaggaaggccgtgaatgccttgtttacagatgatgcgaaaaatgctctaaaattgaacatcacagattatgcagtggatcaagctgccaaccttgtgaactgtttatctgaggacttccatgcacaggaaaaaatgatcctactggatcaagccaagtttgcgaaacgactcagtcaagtgcgtaatctattaaactatggagattttgaatcccctgattggtctggtgagaatggatggaagacaagtccgcatgtccatgtctcatctgataacccaatttttaaaggacgttatcttcatatgccaggcgcgaatcaaccacaaatgagtgatacgatatatccaacgtatatctatcaaaaagtagatgaatcgagattaaaatcctatacgtgttaccatgtacggggatttgtgggtaacagtaaagatcttgaattactcgtggaacgatatggaaaagaagtccatgtcgaaatggatgtgccaaatgatatccgttatacattaccgatgaatgaatgcggaggatttgatcgatgtggtcatagctcttatcaagctggcacagattctcacacatgtacatgtaaagatacggctcgaatggatgcggagtgtcaatgtaaagacaaatcaaaacgtatcgcatcgggtgtatataccaacgcatatgcaggtagtgataggatgtatccagatgggcatcatgcacacagatcgtgtggatgtaacaaaaaaggtggatatcaaaatggaaaacatgcgcataaatcttgcggatgcaaagatccacatgttttctccttccacattgacacgggatgtgtggacatggaagagaacttaggtctattgtttgctctaaaaattgcgagtaccaatggtgtggcaaatatagataacctcgaattgattgagggacaacctttaacaggagaggcattagcacgcgtgaaaaaacgagagcacaaatggaaagaagaaatgaaacaaaaacgctgtcaaacagaggaagcggtacaggctacgaaaacagcgattgatgctctattcacaaacaaacaatacaatcgattaaaatttgagacgctgttcctgcacattctccatgcggatgaacttgtacaacgtatcccatatgtgtatcacccattcttacatgatgcataccctgatgtacccggaatgaactatgctattttccaacaactctctgccttggttgttcaagcacgtggattatatgacatgcgaaatctagtacgaaatggcacattcagtgccggcataggaaattggcaggtaacagacggagtagcgacacaaccagaaggaaatacctctgtactgattctacgagaatggagcgataaggccctccaacatctacgaatccatgaagaacgtggctatgtgttacgtgtaacagcacgaaaagaaggcaatggtgacggatatatcgtgatccatgattgcgatcatcaacaggagaaattaacatttacagcgtgcgattacacaagtatgggagcaagcacaagtacgcaaacgatgatgacacctcctacaaattgtatgccatgtaaatcaacaacatggaaggacgagatgacaacatctgtacctatgttgagtgggtatgtcacaaaaacagcggaaatcttcccggatacagatcgtatccgcattgaaatcggggaaacagaaggcatattcaaaatcgaaagtgtggaacttatttgtatggaacacatggaggaccatatgtatgatatggttggaaacttagaagaa

SEQ ID NO: 40 - DNA, 2721 bp, Bacillus thuringiensis
atggaaaaggagctgttaaatttgaaaaataaatatctgaaaccagttgcattaggattgttagcaagtaacgttcttgcgtttggtggtcacacagtagcatttgctgagacaaataaagcagtatcaaaagaacaaacacaaaaagcagatgcattaaagaaggtaaaaacacctttggtatcttttgcagcaactgatggcacatcggaactatctgagttacagaaaattatgaatgaagttataaaagaggacaacggcataactgacatgtttttacagcgtacaaaagagaaggcagaacaaaaaggtatagaatttgattatctggagtttataaaaggcgtattaaatgaagggattatgtttactggagaggctacagaggttccagttctatctttcttaaaccctattatagatgtgttcttccccaaaaatgaaaaagatgtttgggaccaaataaaaccgaaagtagaagaattaattaatgaaaaattagatgaaagatttacagaagagacgttaaatacattagtattgaaattgaaaggtttaactaaaaacgtagaaactctaaaagagaacataaatgtattaaacgggaagggtgaacatccagacaatgcaatgataggagaggcacttgtccaaacagataaggaaaaagaacaaggggacgtaagagcgtctgtaaaagatgtagttgctaatattaatgccatgtcagaggaattcaaaaatggcaaatatgctgttgcgtcgcttccattatatacccaattagcgaacatacacattggattattaaaagacttagctgaacatggtgaggattggggatatactgaaaaacagcaagaccaaaataaggcagatttacagaaagctataaaaacatataccaatactgtgtatgaaacttttaatgaaggtctcaataaaatgaaggaaaaacaggggatgagtaatggttgggatgaggtcaatcgttatgtaaggacaatgactctaactagtttagactttgcctcacagtggtccattatggatgtaacgttatacccacaggctacacatctggataaaacacgtcaaatttattcggatatatataaggataccataggacatactgattatgataaaaaaactggcgatcaatattacgacaaattattaggtatatatagtaaaaaatatccaggagagctcaaaaatctaacgattaacaaattcggacaggatgcgtggactaataaccatataaatggaattgatcaagagtatgaaggatcatcttatgattattgggattcacaatgggatacaaaaggaataaaatcgaagcaaggcacaagaggtgaaagcttaggtagcgcttccttctcagcagacaaaccgttaacaaagaaaaacttccctgatatggtaaaacgaatcagtaatccagatcaaatacctgctgggcacaaagtatcacaaattatatctggatttagagatggtatatgggataatcagccttttatatgtaatgatgtaacagcttatgtaccggaagaaacacgtgcagatacaaaagtagatggttcacaaattgtgggaattgcagcggataaggtgagtacgtctcagaaatttgaaagtgtacttgaatacgtgaatggtgggaatgcaagaaagtcatcagaatctggaggtacattacaatttgaagtaaatagtacaaagaaacagcaatttaaagttcgttatcgtgttgcatccaatacaggcacatctgtagacttatctctaaaagcaggggcagtaaatgataccggaaaaagttatgcaagcaagggaaatacatcaataccaaatacagaagcattgaaggataatcccaaaaaaggtgtaacaggtctacaaggaacgtacatacttgttgaaggaccgactgttacattacaaccaggtgcgaatgcattagagattacaaatacaggaggaaaagaactagttgtagatcgcatcgaattggcacctgtaatatctaaagcaggaaacccaggatgggacaaggaacaccaacactattatggaaaatcaggtgatggaacaaagctagcagaaggtgaaatggctacggattggcaatcaatagataatcagtattactatttcggtgacgatggtactgtgaaaactagctggcaactaatacgtaataagtactactatttaaataaagatggtactatgcaaactggttggtactcaccttctgaaaaagaaacctactatcttggaaagaaagacgataatacgggtcttaaagaaggagaaatggctactggttggatgaacattaacaatagtgaatattactttggaaaaaaagatgataatacgggtcttaaagaaggtcaaatggctactggtaagataaaaattggtaataaagattatgactttggaaaaaacggtgaaatgcaaaaagaccaacctggatggaaagatgatcaaaagtattatgtggatgaaaatggaaatcgagtgacaggtttaaaaactattgataatttcgagtactattttggtacaggtgacgatggcacgaatcttcaaaggggtgaaaaagcagtagggtggcaaaaatttaaggatggccactatgaatacggggtatgtgtagcaatggaacaaaatcacgcaacaagcattagcggacat

SEQ ID NO: 41 - DNA, 2325 bp, Bacillus thuringiensis
atgcgtataaatcccatcataaaatgtgttgccaccactacattatttagtcagtttttgacctattctagtgtttcttatgcagaagagaagcaatcacaaacaaaaataaaacaagtgatgcaatctgagaaggcgtcacaagtatctaacgaatcctcacaaggactactaggctactattttcaggattcgaactttcaacaactcactatgatggcacatagacaagtctctgatttacaaataaccaaaaaggaagtaaagaacttattagctgatgatcaacaacacattggatctgtgagatggattggttatattcaaccatctcaaacgggagattacatcctgtcaacctcatccgaccaacaagttgtgattgaacttgacggcaaaatcattctgaatcaatcttctatgacagaagctatccaacttgaaaaaggaaaaccgtataaaattcgaatagaatatgtaccagaaaacaaaaagaacaaagataacctccttgactttgaactcaattggtcaatttcaggtggtacagcagaacctgttccagacaatgatttcctgttacccgatctttctcgtaaacaagatcaagagaaaatcatacctgagactagtttattcgaggagaaaggagaagagaaaaatgtgtcccgtagtaagagatctctagctgtaaatcctcttctggatacagatgatgacggtatttatgatgaatgggaaacaaacggatacacgattcaaggacaattggcagtaagatggaacaattctatgaaggagcagaactaccccaaatatgtatctaatccttataaatctcatacggtagcagatccatacacagactgggaaaaagcatctggtcgtatcgatcaagctgtgaaaagggaagccaaaaatccattagtcgcagcttatccagtggttggtgtaaatatggaaagattgattgtctctgaaaatcaaaatatatcgacaggactggggagaacagtcactgcatctacatccgcaagtagtacagcagggattacagcagggatcgatgcaacagttggtgcctctttacttgggccttctgggagtgtcactgctcatttttcttataccggttctagtacagccgctgttgaaaatagctcaagtaataattggagtgacgatcttgggattaataccgctcattctgcgtatttaaatgcaaatgtacggtactataatacgggaacagcaccaatctacaatgtcacaccaaccacaaattttgtattagatagtgagacgattgtaacagtgagagcgaaagaaaatcaattaggggatgtgttaaaagcaggtggaacttatccggaaaaacatttaaacccaattgcgctcaatacattagatgattttggctctcagcttattcctattaactatgatcaaacaaaacgattagaaaatgggaataagctgcagctacagaccacacaggctagtggattatacggcaagatgaatagtaacggaggactgaacatacatccatctcaagagtgggaacctgttcgggcacaaattgaaagtgtatcagctggtattgtattagatactggagaagaagtgttagaaagacgagtagctaccagagatgatcgtgatccagaagatttaacacctgagattacgataggagaagcgattaaaattgcttttgatacaactgaacaaggtgggaaactacagtataaagatacaccactgaatgaaagtttagtagagttaatcgttgatgagtctactgcgagagaaattaaagcacagttagatggtaatccaggcttagagaaaaaaatctataatgtaaaattaaaacgcggtatgaacattatgctgaaaaagcctatatggtatagtgattttgatacgcatcagcacaattggagtaatattacaatagctccagaagaagggattacaggcaacgctgggaagattagtcaaggaagtgttcagccagcattccttcgatatcaaacagtagaagattttaaaaacttaaaaccgaatacacgatataaattaagtgcctctatcaggtacttagatttagagcctggaggggtgacgggtgcatacatcagagtaaatgatctacccaataatgaatacttgattagatcaaatttatatgaacgaatagagagcacatttaccacagggattattccgagtggtattacagatttcagaattgctacaactggatcacgtgatatgttacttgatgatataacattggtagaattaggaccatcaaac

SEQ ID NO: 42 - DNA, 834 bp, Bacillus thuringiensis
gtggatcatatggcgattatcaatctcgcgaatgagttggcaatttgggcaaagaggtggtgtgctgaaaagggatacacatatgaatcaagtggcctacaggctcatactggtaattatggtagaatatacaattataatatatctgtaccagaccctattgtaactgataatcctacaaatacagctatggcgaggggaaccacgccaaattcaactagtcagcctatagtcagaacgattacatttaatgaaacgcttactgattcacagtctacaacaacagaacatggtatcacagctggagtaagtgcgacagtaaaaagtgaagcgggatttgtttttgcaaaggtaggttttgaagttacggtttcatttcaatacaattacacgactacaaacacatatacgacagaaacgtctcggagttggacagattcgcttcaagtcaccgttccgccaggttatgtaacggaacatacatttattgtgcaaactggtccatatagtaaaaatgtagtattagaggctgacatagcaggacatggatggtttaattatagggctcctggttatactgctactggaatagttaatatcacacgagtattatatgacaataaggttccaggcattactccctatccagacgatttctatgctcgattcagaggttcaggaaagttagaaggaaaaatgggacttcaatcttttgtaaatattgtagaaagacctttatcaggtcgtgcagggcaggttcgagaatatcaaattccagtttcgctacaaagtggattaggaatccctatctttgatccagttgtatctcttcag

SEQ ID NO: 43 - DNA, 903 bp, Bacillus thuringiensis
atgtactttcgtttgaagttctctaagtattcgaaaagttccaaagcagaaaaggaagaggtgaatggtatggcgattattaatttattaagtgagttagaagcttacggaagaaattatgcggcaagtcaccaatataggtatgaaacgagttattccgacgacatggatccacttcgaatatcagctatcaatgagaccgttccagatcgtatagttcaggatggtattaaaaatattgtgttagatcgtagaaacatacgtaatacaacttctagtgaattaaacggtgtgtttagtttttcaaatacttatacaaataaaaactctacacaaactatagatggtgtaacagcaggaaccaatataacaattaaagcatttgcgaatttgatgtttgcggaggttggtttgtcggggaatatagcttttgaaggaaacatcacgaatagcaacgttgttacacttgatacaaaccaagattttacggatacacgaaatataagtatccctccacatcatcaagcgacagggttatatatgttgcaacaaggctcatttgaaaaaatgactgttatagaatgcgtggtagccggaaatggaatcatcaggtacactcgttactttcctgatggaagtgcaacagaagttcgacaacgcgtgagtattgtagacgtactacaagcaaatggaacgcctggttttacggtatcaccgggccaacaacaagcgtattttacaggagaaggaagggtgttcggacaactggggctacaaacatttatagatgttgtcatcgagccattaccaggctactcaggacaaaggcaacagtatcaaattccagttacgggaagaagtggattagatattcctgtttttgacgcgttaggagttcgacaa

SEQ ID NO: 44 - DNA, 4092 bp, Bacillus thuringiensis
gtgtcagttaagtgggtttgcatggacgaatcgaaaaaaacaattggaggattgtgtatgaatcaaaactataacaacaatggatatgaagtcatggatagtggtggcatgtatcatcagccaagatatccgtatgcgaaggcgccaggttctgaattccagcagatgaattataaagattggatgaatcagtgtaaatggggggaatccggagaattatttgcaaatgatctaggtccggttagggatatgcttattatcggtacaggtattggctgggctcttctcggatttgttccgggtattggtccaatattatcagcagtagcaggggttttaaatgtggcgataccatacctatggccggaggacgcaggaactccagggactccagaagcgcaattttcatgggatcaactgatgacagctgcggaacagattactaatacagcaatcaacgcacaagtacgcgctgaagcgattacagaattacaaggaattcaagaaactatccggctatatcgaggtgcggcttgtgattggaaaaacgatccaaataatgctcagcttaaagaaactttgagaacacagtttatcgctacgaatacagttatttttaataggatgccatcttttagagtagcaggttttgaaacatctttattacctacttttgtgcaagcggctaatttacatttaggccttttaagagatggagctaagtttggattgcaatgggggatggatccagcaacagtgaatcgatattatggttacctgacaagtaatatagcaacctatacgaattattgtacaagttggtataatacaggtctacaacaacaatataatactggaaactgggataaatttaataatttccgcagggatatgaccatttcggtactcgatattgtagcagcatggccaacatttgatacaaatttatatgcagttcctacatcatcacaacttacaagaactgtgtatacaccgcttcaaggaaatttaggagcaaacgctcttagtccggaagcatctccatctattgacgttatagaagaaaatctcgttgatactccagggttatttaaatggttgcataaggtatcgtttgaggcgataaacggtttacaatctaccgtaatcaaagggcgtgggatcggatatagatacactatgaacgattcgataatagatggaggatatcaaggagagcacggcacaatgacagagaccctccctattacatacccaacagatagatatacacctgttggtgacgtctggaatgttaccaatcagttgtaccagctgcggcttgtttttcccgacaggactgatgttatcagcgctgtaagaggatttcttttccgtggtacggaacctactgtagtaagcgctattccggtattctataaccccggttatcctattgaaacaacttcaggacttccttgtagaggtatggcttctgtatgtgagacatgtgagcctaactgtatgcctcaacttcctaatggggggagtatttgtgagagcggcctccaatatggtaatagactttcatatgtgggcttaggtatgttaactgcggtcccggggtattatgtaggttcacctacacggtatgcagcttattttggttacggctggacacatgtaagcgcaaatgcaaacaatctgatagacgctgaaaagattactcaaattcctgcggtgaaggcatcatccgtaaccacaggcgtacaggttataaaggggcctggtagtactggaggagacttagtgaaacttggtggtggaaacatcctaatagcaacgctagcactgaaattcacagttccagcaggacaacgccaatttcgtataagaatacgttatgcaagtaatatgcgaaccaatttaacgattagtatgcccgggtatagtggaacatattatcctcctactactacaactgatttgacaaatctcacatatgataagttttcataccaagacatcggaacatattctttcaatagttctaatgattctataaccagcttaaatttgagagttcagggggttggttcgatttcatcagttagttctttcctgctcgataaaatcgaattcattccaattcagggttctttagaggaatatcaagcacaagaggcattagaaaaagcacagaaggctgtgagcgctttgtttacgaatgatggaaaacatacattgcaattgaatgttacggattatcaagtggatcaggccgcaagactcgtagaatgtatgtctgatgaaatctatccaaaagaaaaaatgtgtttactcgatcatgtgaaatgtgcgaagcgactcagtcaagctcgtaatctactaaaccatggtgactttgaatcatctgattggtctggcgcaggtggatggagcgcaagcaatcatgtgtccgtagaatccgataatccaatctttaaaggccgttatctcaaactgcctggtgcgaatcagccgcaatttagtaatcaggtattcccgacatatgcatatcaaaagatagaagaatcgcgattaaaaccatatacgcgctatagagttcgcggatttattggaaacagtaaagatttagaagtattcgtggcaaggtatgagaaggaagtgcacaaaaagctacatgtaccaaatgatatcatcccatcaaatccatgtacgggagaatatccattggaacaaggtgcgtatcctgtggtgacaaatcaagtcataccacaaaacatgtcatgtggtccatgtgatgatgggtcacagatgatgatgcaacaaacaagtatggtatgtgtagatccacatgaatgggagtgtcacattgatacgggtgagttagatatgaatcagaatctaggcatctgggttggttttaaaattggaacaacagatggtatggccttactagataacttagaagtagtcgaagaaggtccgttaacgggagaagcgctcgctcgtatgaaaaaacgcgaacacaaatggaaacaaaagtggcacgaaaaacaaatgaagatagaaaaggctgtgcaagtcgcacgaggtgcgattcaggcgttattcacaaatgcagaccaaaatcaattacaatcatcgattaccttgcctgagattctccgtgcggagacaggggtacaaaaaatcccatatgtctatcacccattcttaggaggagctttaccaaccgtaccgggagaagcgtatgatatcttccaacagctctcgaatgccgttgcgacagcacgggcgctatatgaacaacgaaacgtactgagaaatggagatttcaatgcaggattagcgaactggaacggaacagagggagcgaatatccagcagattggaaatgcatctgtgcttgtcatctcagattggagtacgaatgtttcacaagaagtatgtgtccatccggaacagggatatgtgttacgtgtcacggcgaaaaaagaaggttctggagaagggtatgtaaaaatcagtgatggtacggaagaaaatacagaaacactgaaatttatagcgggagaaggtacaacaagtgccacatcatcgatgatgccgcctcgggaatcctattatgagcaagatatggcgaactactcatcagaatatacgggggcgagtacctatacaacgggtaattcgatgaattaccaatcagaaagtttcggaatcaatccatacagtgatgagtatgggcagatgaatcatccatcagccccttatatgggaacagattgtggatgtggctgtcgtacaaacgcgtacgctggtgattatcctaccatgagtgatgcatcaaacggatatgaaaggaatgcatatccaggtagcatcaaccaaaccaatgcgatgaaatcaagttgtggatgcggttgccatacgaaaacatccgtaagtgaaacgaacatgacgacgtacccttccgagtctctttcaggttatatcacaaaaacggttgaaatcttcccagagacgaatcgtgtatgtattgaaataggagaaacatccggcacatttatggtggaaagtgtagaattgattcgaatgggttgcgaa

SEQ ID NO: 45 - DNA, 2049 bp, Bacillus thuringiensis
gtgttgatgaatcaaaattgtaaaaaagataaattgaagctgtcggatagtgggaacaggtcttgtcagccaaggtatccttttgcgaaggaagcaggttctgagttgcaaaatataaattataaagattggttagttatgtgcttagatgaaaaacaaagcatttcaaacaaccaacagagggccgtgatagattcagctcttttaactacatcagatattacacaaaccattttaaatattggcaataccgctacgtctcttaggtctccaggaatgattgccgggcaaatacttctacttgttattagatttctatggactaaaatttcagggcaaagaaaatggacagagatgattaagactgtcgagcttcttattaaaaaagcgcttattcaacaaatgtatgacgaagcagtgtctcgattagaaggattagaagatgtagtagacagatatttaaaagcgttggatgacttacatatagaccctactaatctaacgctacaggaagaagtaagaattagatttgatgcagcagataccgcttttattgctgccatgccacaattcaggccaggtgttgctggaggagaccctcaagtcttattgctgcccgtgtatactcaggcagcaaacctacatttattattattacgagatgctatagcatttgggggggaatggggcatggaccctgccacgattaacaccaattacaacgtatttctaactcgactgtcaagctatacagatcattgcaggaatacgtatgacagtggactacaaaaagcacatcagttaccgccgaattatgattacaaatcgaatgatttcccatggatttcaccaagtctaaaagatggagtgtggggttttgaagaaggatattggagacatgttatagattggaattactttaacaattatcgaagagatatgacgataattgtattagatgtagtttcactttggccaacatatgacgcaaggatgtttccgattcctgttaaaatagaacttacgcgagaactgtattcagaactcatgggccaaaataatggagaaaatcaggatcaaatcgaatctatgattgtacgatcacctcatttattcacttggttaaaaaccattaaaattgggacgaaacagccaaaaagtaactgttctcaaatcgaccagtatgccgatataaaagtcaccttacaccatacgaatgacaataacttgtgggatcaaacaactgttatagctgccccaagaacaggagaacaggtcctggaaaacagttccttcggtcgtgtagagttatctggaacgtattctccgtacatgtttcgattttatactccatataatggaggaggttattttgttggacgggatgtcccaaataccacatgttactcaccacattgtaatggttggggggggtgtagccaatcgctttcacagattcgatggtacataggaacggagataccatcgagcagtttgccacatagtcatcgactatcctatatagatggttgtactactactgaaccttattttgacaaatcgacttatataagcgcatgggtatttgcctggacacataatagtgtaggtcctaataacacaatattttcagataagatcacccaaattccagcggtgaaagggaatggactagaaaacattgcgacgggaactgctactgtaaggagaggaactggtagtacaggaggagactttgtacagctgattggaaatacacctgctggggaggggcggttgcatattagttttacttccttaggagcccgaaattatcgagtcagattccgttatgggagtacaactggtggtaggctacgggtatctactcctaccggtaataagtatactaatattcaaagaacttatggtggaggacttccaacagcatataacgaatttcaatatgcggacttgggcgtacagacagtatatgcgaatcactggttcgtgattgtagctgaaactggaacaaatgtaatcatcgataaaatcgaatttattccggca

SEQ ID NO: 46 - DNA, 3543 bp, Bacillus thuringiensis
atggataacaatccgaacatcaatgaatgcattccttataattgtttaagtaaccctgaagtagaagtattaggtggagaaagaatagaaactggttacaccccaatcgatatttccttgtcgctaacgcaatttcttttgagtgaatttgtcccaggtgcggggtttgtattaggtttatttgatttaatatggggatttgtaggcccctctcaatgggatgcatttcttgtgcaaattgaacagttaattaaccaaagaatagaggaattcgctaggaaccaagcaatttctagattagaagggctaagcaatctttaccgaatttactcagaagcttttagagaatgggaagcagatcctactaatccagcgttaagagaagaaatgcgtattcaattcaatgacatgaacagtgctcttgtaacagctcttcctcttttttcagttcaaaattatcaagttcctcttttatcagtatatgttcaagctgcaaatttacatttatcggttttgagagatgtgtcagtgtttggacaacgttggggatttgatgtagcgacaatcaatagtcgttataatgatttaactaggaatattggcgaatatacagattatgctgtacgctggtacaatacgggattagaacgtgtatggggaccggattccagagattgggtaagatataatcaatttagaagagaactaacactaactgtattagatattatttctctatttccgaactatgatagtagaacgtatccaattcgaacagttgcccaattaacaagagaaatttatacaaacccagtattagaaaattttgatggtagttttcgaggctcggctcagggcatagaaggaagtattaggagtccacatttgatggatatacttaacagtataaccatctatacggatgctcatagaggagaatattattggtcagggcatcaaataatggcttctcctgtagggctttcagggccagaattcacttttccgctatatggaactatgggaaatgcagctccacaacaacgtattgttgctcaactaggtcagggcgtgtatagaacattatcgtccactttatatagaagaccttttaatatagggataaataatcaacaactatctgttcttgacgggacagaatttgcttatggaacctcctcaaatttgccatccgctgtatacagaaaaagcggaacggtagattcgctggatgaaataccaccacagaataacaacgtgccacctaggcaaggatttagtcatcgattaagccatgtttcaatgtttcgttcaggctttagtaatagtagtgtaagtataataagagctcctatgttctcttggatacatcgtagtgctgaatttaataatataattccttcatcacaaattacacaaatacctttaacaaaatctactaatcttggctctggaacttctgtcgttaaaggaccaggatttacaggaggagatattcttcgaagaacttcacctggccagatttcaaccttaagagtaaatattactgcaccattatcacaaagatatcgggtaagaattcgctacgcttctactacaaatttacaattccatacatcaattgacggaagacctattaatcaggggaatttttcagcaactatgagtagtgggaataatttacagtccggaagctttaggactgtaggttttactactccgtttaacttttcaaatggatcaagtgtatttacgttaagtgctcatgtcttcaattcaggcaatgaagtttatatagatcgaattgaatttgttccggcagaagtaacctttgaggcagaatataatttagaaagagcacaaaaggcggtgaatgagctgtttacttcttccaatcaaatcgggttaaaaacagatgtgacggattatcatattgatcaagtatccaatttagttgagtgtttatctgatgaattttgtctggatgaaaaaaaagaattgtccgagaaagtcaaacatgcgaagcgacttagtgatgagcggaatttacttcaagatccaaactttagagggatcaatagacaactagaccgtggctggagaggaagtacggatattaccatccaaggaggcgatgacgtattcaaagagaattacgttacgctattgggtacctttgatgagtgctatccaacgtatttatatcaaaaaatagatgagtcgaaattaaaagcctatacccgttaccaattaagagggtatatcgaagatagtcaagacttagaaatctatttaattcgctacaatgccaaacacgaaacagtaaatgtgccaggtacgggttccttatggccgctttcagccccaagtccaatcggaaaatgtggagaaccgaatcgatgcgcaccacaacttgaatggaatcctgatctagattgttcctgcagagacggagaaaaatgtgcccatcattcccatcatttctccttggacattgatgttggatgtacagacttaaatgaggacttaggtgtatgggtgatattcaagattaagacgcaagatggccatgcaagactagggaatctagagtttctcgaagagaaaccattattaggggaagcactagctcgtgtgaaaagagcggagaaaaaatggagagacaaacgtgaaaaattggaattggaaacaaatattgtttataaagaggcaaaagaatctgtagatgctttatttgtgaactctcaatatgatagattacaagcggataccaacatcgcgatgattcatgcggcagataaacgcgttcatagcattcgagaagcatatcttccagagttgtctgtaattccgggtgtaaatgcagctatttttgaagaattagagggacgtattttcacagcctactctctatatgatgcgagaaatgtcattaaaaatggcgatttcaataatggcttatcatgctggaacgtgaaagggcatgtagctgtagaagaacaacataaccaccgttcggtccttgttgttccggaatgggaagcagaagtgtcacaagaagttcgtgtctgtccgggtcgtggctatatccttcgtgtcacagcgtacaaggagggatatggagaaggttgcgtaaccattcatgagatcgagaacaatacagacgaactgaagtttagcaactgtgtagaagaggaagtatatccaaacaacacggtaacgtgtaatgattatactgcgactcaagaagaatatgagggtacgtacacttctcgtaatcgaggatatgacggagcctatgaaagcaattcttctgtaccagctgattatgcatcagcctatgaagaaaaagcgtatacagatggacgaagagacaatccttgtgaatctaacagaggatatggggattacacaccactaccagctggctatgtgacaaaagaattagaatacttcccagaaaccgataaggtatggattgagattggagaaacggaaggaacatttatcgtggacagcgtggaattactccttatggaggaa

SEQ ID NO: 47 - DNA, 3393 bp, Bacillus thuringiensis
atgaatcaaaaaaactatgatattatgggggcttccacaaacgccacggctgaattgactgaaaactacaacactataatcagcccttatggagctccaacatcagttactacaactattgaaatcactggaaccatactaagcgatttaggtgttccaggagcatcatcaattagtttacttctaaataaactcttaagtatattatggccagatgataccaataccatgtgggggacattcgcaaaagaaaccgcttatcttcttaatgaagtgttatctccgaatgatccagtagtaatagatgcagataataaattagaaggcttaaaaaatactcttgatttatatttagaggcacttaaagaatggaaaaacgatccccaaaatccagcatcccaagagcgtgtcagaactagatttcgtaatgtggatgatgattttacacatgatatgccttcatttgctagagctggatatgaaacgaagctattaacagtttatgcacaagctgcaaatcttcatttgcttttattaagagatgcttctatgtttggagaaggttgggggatgactcaagtaaacataaatgataactataatcgccaattacgattgacagctcaatacacggatcatagtgtaaagtggtataacgcaggattagaaaagttaaaagggaaattaactggggaaaattggtacacttataatagatttcgtagagaaatgacattaatggttttagacgtagttgcgttatttccaaactatgatacaagaatgtatccaattgcaacaacatcagaacttacaagaataatttatacagatccaattgcttatacacaagatcatccatggtacaagataacaagtctttctttttcagatattgaaaatagcgcgattccaagtccttcttttttcagatggctcaaatcagtttcaattaacagccagtggtggggcagtggtcctaatcaaacttactattgggttggacatgaattggtatatactaattcaaattacaatcaatcacttaaggttaaatatggagatccaaattcttatattgaaccccctgattctttcaatttttcttctacagatgtttacagaaccatttctatcgctaaaaattcaatatctaattatatagtaagtgaagttcgattcaattcaattagtaatacaaataaaattagtgaagaaatttataagcatcaatcaaattggcctctaaaggaaaccaaggattcaattgctgagctatccatagctgctaatcctccaacaacatttggaaatgtagcggaatacagtcatagattagcatatatttcagaggcatacagtagtcacaacccatcaaaatatccagcctatattccagtatacggttggacacatacaagcgtacgttacgataataaaatttacccggacaaaatcactcaaattccagctgttaaaagcgcctctgttgaaggtggaacatggaaaaatgtagtgaaaggtcccgggtttactggaggtgatgtaacaacggctgtttcgccagcaaatttaatagacgtaataaaaatacacgttactctagattcaaattcactttcacaaaaatatcgcgcaagacttcgctatgcttccaatgcatatgtagcagctacattatacacaaacacaagtagtaattatcattttgaacttacaaaaggtacaactgaacagttttcaacatataactcatttcagtatgtagatattccaggttcaatacaatttaataatacttctgatacagtgtctgtttatttgcatatggattcaacaactaacgcaagtgtccaagtagatagaattgaatttattccagtagatataaattatgatgaaagagttcaattagaaaaaacacagaaagccgtgactgctttgtttacagcgggaaaacatgcactccaaacagatgtgacagattataaagtggatcaggtgtcaatattagtggattgtgtatcaagtgagttatatcccaatgagaaacgcgaactacaaaatctagtcaaatacgcaaaacgtttgagttattctcgtaatttactcttagacccaacatttgattctattaattcatcagttgagaatggctggtacggaagtaatggtattgcaatagggaatggtgattatgttttcaaagggaactatttaattttctcaggtaccaatgatacacaatatccaacctatctctatcaaaaaatagatgaatctaagctcaaagagtatacacgctataaactgagaggatttatcgagaatagtcaagatttagaagcatatgtggttcgctatgatgcaaaacacgaaacattagatgtttccaataatctattaccagatgttctccctgtcaatgcatgcggagaacccaatcgttgcgtggctctacaatacctggataaaaatccaaggttggaatgtagttcaatacaagatggtattttatctgattctcactcattttctctcaatatagatacaggttctattgatctcaatgagaacgtaggcatttgggtgttgtttaaaatttccacaccagaaggatatgcgaaatttggcaacttagaagtgattgaagatggcccagtaagtggagaagcattagcccgtgtgaaacgccaagaaacgaagtggagaaataagttggcacagctacgaacggaaacacaagcgatttatacacgagcaaaacaagcgctggataatctttttacagatgcacaagactcttacttgaaaataggtgctacatttgcggcaattgtggctgcacgaaagattgttcagtcaatacgtgaagcgtatatgtcatggttatctgtcgtcccaggtgtaaattatcctatttttacagagctgaacgagagagtacagcgagcattccaattatatgatggacgaaatgtcgtgcgtaatggccaattccttaatggagtattggattggattgtgacatcagacgtaagcgtacaagaagaaaatgggaataacgtattggttctatccaattgggatgcgcaagtattacaatgtctgaaactctaccaagaccgcggttatatcttgcgtgtaacggcacgtaaggaaggattgggagaaggatatataacaatcacagatgaagaaggaaatacagatcaattaacatttggttcatgtgaggagatagatacatccaattcttttgtatctacaggctatatgacaaaagaactggaattcttcccagatacagagaaagtgcatatagaaataggagaaacagaaggaatattccaggtagaaagtgtagaattattcttgatggaagatctatgt

SEQ ID NO: 48 - DNA, 3612 bp, Bacillus thuringiensis
atgaatatacaaaactctaatgatgctaatacaaaccgtattttaaacaatggtttatcggtatcttctacagctaatctactggaattagtacaacaaggacgttcagattatgcagggaaatgttatagtggatatatagacttaattggtgaacccagaagtacgcccatatcaaatcgtttctctaactccatattaccaaatacaataacgaatgacccgcgaattgttgagacgtgtggtaatggctcaatagtggataatactgtacaagattcaatcacaacagttattgatattacaaatataattttagatttatttaatgttcctattgttgggcctgtattatccattgttaacaggcttataaatagattatggccatccaattatggaacggctatttgggaagcgcttatggctgaagtggaaaaaattgtagataaaaaaatagacgaagcagtaaaatctaaggctctttcagaattagaaggattacaaagaatttacagttcttaccaatccgatcttgaacgatggttaggtgaccgtgataatccagaatatcaagagattatacgacagcaattcaacgtggtgaataatttctttgcttatcaaatgccttcatttgcagtgtcggggtttgaaatattactattatctgtatatacacaagctgctaatttacatttaaacttattaagagatataactgtgcatggtactggttgggggtattcagaagggactgtagaacgctataatcaattacaacgctgtctaataacagcttatgtagattattgcgtagatcaatataatttagagttagaaaaattgcctaaagaaactcttaaaaattgggttgactataatcgttatcgtcgagaaatgactcttagcgtcttggatatagtttcccttttccctaactatgatgcgtccgtatacgacttaccaatcaatgctgagctatcaagacaagtgtataccgatccgctgggtagttatcttccatacaacactgctaaccctatttcatggtacgatatgaaatcttatatccacccgaatttttggcagatagataagtacttcattaagccaccaaatctattcacttttgctgaaaaactcattatgtactcaggctatagaacggatgtagatccaattttttactattattggtcaggtagcaaattagaatcaagaagagtgcatggaaacgaaattataacaaccatttccggcgatatcagtcaatccataacattagtcaatgttgatttcaaggatagtgatatttataaaattacaacaaattatataggtcaatatacagggagtttattaggaacgaatccaattacatttagtttaacaaactctaacggtcaaaccgaacgaaaatatgaatattcaaagcttttaatgcctggcaaggaaaaaatatattattcacaggatgagatacctccaaatatagaaacgggcgaacctgactatgttgcttattcacataggcttagttatgttagtgcttttaaccctaattttactagcggaaaaaaaataggaacagttccgatatatggttggacacatactagtgtaagtcgtgataacctaatttatccagataaaattactcaaatccctattgtaaaatcctatgagattggcgaatactataaagtgatgcagggtcctggatttactggaggagatatactaactaaaacttatccggtgcagaatccatctggcagcactttggctgcaaggataagagtaagtacagcaggaatacatttgaatcaacgttacactttgagaatgcactatgctgcttcgggtagtgtatatgatgcaatgataattaaacccggtcaatcggagggaggttatcatatgagattgaatcctactatggagaatggagagactttgacatttaactcatttacttcaatcggaatgaattcccaagttttgacgagcagccaaacagatttgactctttatataaaatcaatgagcccttcaacacccgggactatttatattgaccggattgaattcatcccggtagacaacaattatgaagcggaacaaaatttagaaaaagcacagaaagcagtgaatgctttgtttacagcgggaagaaacgcacttcaaacagatgtgacagattataaagtggatcaggtttcaattgtagtcgattgtgtatcaaaggaagtatatccaaacgaaaaacgagaactacaaaatctagtgaaatatgcaaaacgactcaccaattctcgtaacctcctggtagatcctaatttcacatccattaattcagaaggtgtgaatggctggtatggaagtaatgggattgtgattggacatggtgatgatgtatttaaggggaattatattcaattagctggtaccaatgatgcacaatatccaacgtacctgtatcaaaaaatagatgagtctaaactcaaagaatatacacgttataaactgagagggtttatcaagagtagtcaggatttagaagcatatgtgattcgctatgatgcaaaacatgaaacattggatgtatccaataatctattcccagatatttctcctgtgaatgcatgcggagaaccaaatcgttgtggggcattacaatacctggatgaaaatccaaggttagaatgtagttcgatacaagatggaattctatctgattcacattcattttctcttaatatagatacagggtctattgatttcaatgagaacgtaggcatttgggtgttatttaaaatttctacacctgaaggatatgcgagatttggaaacctagaagtgattgaagatgacacagtcattggagaagcattagcccgtgtgaaacgccaagaaacgaagtggagaaacaaattgacacaactgcgaacggaaacacaagcgatttatacacgcgcaaaacaagccattgataatttattcacaaatgcacaggactctcacttaaaaataggtgctacattcgcgtcaattgtggctgcacgaaagattgtccaatccatacgtgaagcgtatatgccatggttatctatcgtcccaggtgtaaattatcctatttttacagagttgaatgagagagtacagcgagcatttcaattatatgatgtacggaatgtcgtgcgtaatggccgattcctaagtggagtgtcagattggattgtgacatctgatgtaaaggtacaagaagaaaatgggaacaatgtattagttctttccaattgggatgcgcaagtattacaatgtctgaagctctatcaagatcacggatatatcttgcgtgtaacagcacgtaaagaaggattgggagaaggatatataacaatcacagatgaagaagggcatacagatcaattgacatttggcacatgtgaggaaatagatgcatctaacatgttcgtaaccacaggttatatgacaaaagaactagaatttttcccgaatacagagaaagtgcgtatagaaattggggaaacagaaggaaccttccaggtagaaagtatagagttatttttgatggaagatctatgt

SEQ ID NO: 49 - DNA, 1896 bp, Bacillus thuringiensis
ttgaattctaaatctatcatcgaaaaaggggtacaagagaatcaatatattgatattcgtaacatatgtagcataaatggttctgctaagtttaatcctaatactaacattacaaccttaacagaggctataaattctcaagcaggtgcgattgctggaaaaactgcattagatatgagacgtgattttactctcgtagcagacatatacctagggtctaaaagtagtggagctgatggtattgctatagcgtttcatagaggatcaattggttttatcggtaccatgggtggaggcttagggattctaggagcaccaaacgggataggctttgaaatagatacgtattggaaagcatcttcagacgagacaggggattcatttgggcatggtcagatgaatggaccacatgcagggtttgttagtacaaatagaaatgcaaactacttaacagctttagctcctatgcaaaaaatacctgcacccaatgataggtggagaattctaactattaattgggatgcacgtaacaacaaattaacagcaaggcttcaagagaaaagcaatgatgaccctactagatccgctacaccaaattatcaaacatgggagctattaaatcctgcatttgatttaaatcagaaatatacttttgttattggctcagctacaggggctgctaataacaagcatcaaattggaatttctttgtttgaagcatactttacgaaaccaactatagtggcacatcctgttgatattgaaataggtacagcatttgatccattaaactatgagccaattggacttaaggcaacagatgaagtagatggagatataacaaaggatattacggtagaatttaatgacgtagatacatctaaaccaggtgcataccgtgtcacatataaagtagtaaatagctatggggaaagcgatgagaccgcaatagcaatcgtagtatatacgaaaccaactataactgcacatgatgtcgcgattaagaaagaattagcatttgatccattaaactatgaaccaattggactcaaagcaacagatccaattgatggtgatataacagatgaaatttcggtgaaatttaataatgtggatacctcaaaaccaggtaaataccatgtcacatataaagtagtaaatagttatgaaaaaagtgatgaaaaaacagtagaaatcacagtatatacaaaacctattatagaggcatatgacgttgaaataaaaaaggatacagcatttgatccattaaactatgagccaattggactcaaggcaatagatccaattgatggtgatataacagataaagttacggtagaatctaatgatgtggatacctcaaaaccaggtgcataccgtgtgaaatataaagtagtaaataattatgaggaaagtgacgaaaaaacaattgctgttacggtacctgttattgatgatggatgggagaatggtgatccgacaggatggaaattcttctctggtgaaaccattactctagaagaagatgaagagaatgctcttaatggaaaatgggtgttttatgctgataaacatgtagcaatatataaacaagtagagttaaagaacaataccccttatcaaattacagtatatgttaaaccagaagatgaaggaactgtggcacaccatattgttaaagtttctttcaaatctgattctgctggtcaagaaagtgaagagattataaatgaaagattaattgatgcagaacagatacaaaaaggatacagaaagttagcaagtattccatttacaccaacaacaattgttccaaacaaaaaaccagtgataattgttgaaaactttttaccaggatggataggtggagttaaaataattgtagagcctacaaag

SEQ ID NO: 50 - DNA, 954 bp, Bacillus thuringiensis
atgaaattcaataaattaatggtaagtggaattgcttttgtttgtagtagtacgttttttacagcgtatatacaagcagcagaaattgaagaaaataaaaatagtaccacagctttaagtgagtcacgtgaagaactttttgggattgtcgatgtagataaatcattcgataaaatggcgcaatactattattttaagaatttacaagggaaaatagaaaacggctataaattcactaattataaaggatcttcaactaatctagataaatttaaaactacgtcagataaagtttctgatttacaaattacaggtttgctaccagaatatatcggtggaaatacatttccaaatcatacggaacaagaacaaactttttcaacgacatcatatgctcgtacaattactgaaagtgtcactaccactacacaatcagggtttagtgtatcagggcaaggaggtttattaaacatcccaattattttcccaaatggtacaagtataactgcatcaatcaatacatcttcaactctagccaaacaagaatcagacacaagaacattaactgctccttcacaagctgtaaaagtaccaccaggaaaaacatatagagctgaagtgaaacttgttagaaaatcttttaaggcaaatgtaggatttaatggaactattgcaccccctctgagtacagatattaaaatgaatgcacgatgggaaggtgctggtggaagaccgaataaaaccgttactaaaagttatgctacacaaactttatacagagatatgacgcctagtcaacaaaaggatctaggaatcacatttaattctacaacaggacaatttgatgtaaacgggaaagcggttatagatggtattgctggtagtgaaatggaagtagcgatttacgatattactaacgcacgtacccctaaattagtcagtaaaacttattat

SEQ ID NO: 51 - DNA, 2019 bp, Bacillus thuringiensis
atggcatttaaaaatgatgaaactccaaacagtactgacagtaatacagaagatattagcactttgaaaacagcggaaacatcagtaagtggccctgccaaactttactcatcatgttctttaacagagaaaagtttatatgagatagaaaatgaatggaaaagatggtctaagggaaacgattttctttatatcccacctgtagtcggaactgtctcatcacttatacttcaaaagattgcaggtatgattggtgataagttattaaaatctgtatttgaaaaactatttcctacaccgaatccagttacaatgctggaaattttagaagctgttcagaaattgctggatgaaaggttgagccaggaagttcatcaaaggattactttagaattagaggggttacaacaaaatatcactaatttcttagaagatgttgaagatttcgagggtcttattattatagataagttagaagatggaaatcaaccattggcaataatcgactcaattaatactttaaaccaattatttgataataggatgccacagtttagaaatcctagttacaaagtcttattgcttccattatatgcacaagccgctaatctccatatctcctttttaaaagatgttgttgataatgcttccaaatgggggcttactgcatcccaaataaaaacgtatacaaatagatttttagataaaattagtgagtattctaactattgtatagaaacatatcaacatgattttcaatcgaaattttctcagaaattgcaggatgtattaaaatatagaaactttatgacaataaacgtattagattatacttcattatggccaatgttaagattcacaaaacctttcaacattcgaacaagctcaaatttatatgaaatggggccaactcctggagaggacttcattttcccgtactcatcatgggcgaatttcaacagaatatttcagggattccctaacaaagagttacagtcgatttctgctacaaatagattctacagggcctataaacaatccgggggctggagtatgctcgcaataacggaagttatgggaaaccttacgtgtaattattctggcgggaaatcgattaaatttggctatgaatcccttccatcgtgtccagatgatacaggcgtacagagatgcgatgcagtaaaggaagaaattaatgatttttcaagatcacagttaaatcaagtattattaagtagtagtatcagtacaaccaatcctccttacatgtcagctaaatatttacaaaatgtaaaactttcaaacggtacagtatataatctaattaatggtgaatatggatcttggattagctatccgaactatacgattagaaatataataggttgggcaaagtttatggagtcaaaagctacaaatataatagaggggccatcgaaccaatatgaaggatctttaaggggaaatttatcaacaagtatcgtttctttccaacgtagagaatatgatccatatacaatatataacggtgttaagagacataccattccttctcatactcgaggggtgctcatatccccattggaatattctgacactttcaacgtaggaacaggaacaaaaggaaaatttgttattcatgaaagacatgggaataatggtgatgcagtaattatccctaaaacgaatggtggctatcgtcatggctttgaatatattctttttaacccgtatggtacaaacctaaatatagatatatatgtaaaagtatcagtgccagtacagacgaagttagtctaccttataaacggggcgggtcttactaaagaaatagttaccagtactgataatgacggcgtaacagataatggtcagaaatcaaaaattataaaattatactctaataaacaattagttccaggtaatacgactttttcaatacgaaatggcggactgggagatatttatcttgaaggtattgttgttgttccaaatggttcatctcttatttctaggatc

SEQ ID NO: 52 - DNA, 3507 bp, Bacillus thuringiensis
atgactctaaataattaaaatgaatatgaaataatagataccccttctcgtacttctgtatccaatgagtcctttagataccctttagcaagcaaccaatctacttcattacaaaataggaattataaagattggttaaatacattggaaggcgggaacaatcaaggattcattaacattgagggacggttgtctctagaacaagtacttgcagtttctgcgggagtcgcatcatatattctttcgaaccttggaccgtttggagtttttttctcctatatcataggcgcattttggccaactgctccaagtgatacaagagtttgggaagcttttatggaactaatagaagcacgtatcgatcaaaaaatacaagaaagtacaagaaaggatgcaatagcaaggttacaaggattaggagcggcatcggaagtttatcaggaatcattggaaagttggttggaaaatcagaatgatgcaagagcaatgagtgtagtcagacagcaatttgttgcctttgaacttgattttgttacggcaatgccattttttgaaaggtcaggtgatgaaatactattactagctgtgtatgcacaagctgccaatcttcatttactgttattgagggatgcttctttatatggggcagattggggaatggagccatacgacattgctaattactataaccgccaaaaagaaaggactgctacatattctaatcactgcatggaatggtataaaaagggtttagatgaattatggtcagccgggggatatggcggagatgtttggcaagattacaatgattttcggcgggaaatgactttaagtgtattagatttcgttgccttatttccaaattatgatacacatctgtatccgatagaagttaaaggtgaactgacgagagaaatttacacacctggcattaatatagatatagatagaggtaggttaggtaaagtaactcttgaaaatgcacttgtaaattcgccaagacttttttcatggttaaaagaaatacagttgtttacaaatattaactttaaccctagatggaagtttttgagtgcgactagaattggttataaattaacgggttatcggtctgtaaattttgagccatacgaaggcttctactttgaaggtcttttccaatcaaattttacactcaatgattatcaagagatatatatagttgatgtaacgcgttttggaagtttatatgatacccctactgctattacggcaatgacctttttcaaagatgataatacgaccttcaactattcgtccaatacgccaagtggggaaccaatgatcacttcaggtttctacttaccaggtatcgatggttcagaggagccaacttctaataattttagtcacagattaagtactattaatacatataatactacaaatcaaacattttatcatacatttggctggacacatgttagtgtggatagaaataatacgattgtttcaaataaaattactcaaattccatttgttaaagccaatacgggcaatgtagtaagaggtccggggcatacaggaggagatttagtagtttttaagccagcagcaagaccagatattgtacttagggtgggaaatactagattacaaagctaccgagtaagagtgagatatgcttctaatgcagatatctcactggaacttgatactacgtatgaaaagacgaatatacacctgcaaaaaacattcaattccagtgaggcggaagatctaacatatgataattttcaatacgcagaagctgataatatagtatggcttggacaggatctttctcagtatatagaattccaaaatgcaattaccaatgattcaacggctatagcttattttgaaagagtcgaattcctcccagtaggtgcaacttatgaagcggaacaagatttagagacagcaaagaaagtagtgaatgcgttatttacgaataccaaaaatgcattacagatgagtgtaacggattatgaggtaactcaggcggcgaacttagttgaatgtgtgtccgatgaattatttccaaatgaaaagcgattgttatttgatgcggtgaaagaggccaaacgactcagcgggatacgtaacctgcttcaagattcagatttccaagagataaacggagaaaatggatgggtgggaagtatagagattgagattagagaaggagatactctctttaaagggtattcgctacgtctaccaagtgcaagagagatttacatggaaatgtttccaacatatctgcatcaaaaaatagaggaatcacgattaaaaccgtatacgagatataggctcagaggttttgtaagcagcagccaagatttggagattttttcaattcgtcatgagacgaatcggattgtaaaaaatgtgtccgatgatttactaccgaatctatcttcctattatacttgtgggggagtgaatcgatgcagcacacaaaagtatgtgtataaccgtttagaattccaaaatagtttatcaagtggaaatcgttattctgatgcgcattcattctcaatcccaattgatacgggtaaaatcgatttgaatgataatacgggtatttggattgcatttaaattagctacaacgggcggatacgcaacacttggaaaccttgaattggtagaagaggcaccattaataggagatactttagagcgtgtgcaaagagaagatcaacaatggaaaagtcaaatgacaaggaaacgtgaagaagcagagagaaaatacatggctgccaaacaagcgatagatcgtttatatgcagattatcaagatcatcaattaaatccaaatgtagaaattacagatattacagcaacacaacatctcgtacagtctctaccatacgtaaataatgacgtattacaagaaataccaggaatgaactatacaaggtttacagaattaacaaatagactgcaacaagcatgggagttatatggccttcgaaatatgatagcaaatggagattttcgaaatggattaaatgattgggatgcgacatctggtgtgaatatccaacaaataaatcatacgtctgtcctcgtcatttcaaattgggatgcgcaaatttctaaacaattcacagttcaaccaaatcaaaaatatgtgttacgtgtgaccgtaagaaaagaaggaagcggagatggctacgtaacgatccgtgatggaggcaaccataccgaaacactgacatttaatacatgtgattatgagagaagtaacgtatataatgagaaagtattccaatcaaatgactatggtacaaacaatgtatatcatacgcaaacaacgaatgccaatcgatatactacaaatagtctgtataatgatggaactggctatgtcacgaaaacagtagaatttattccatatacagagcaagtctggatagagatgagtgaaacagaaggagtattttatgtagaaagtatagaatttatattagaagaagtg

SEQ ID NO: 53 - DNA, 3507 bp, Artificial Sequence
  stop codon replaced in axmi120
atgactctaattattcaaaatgaatatgaaataatagataccccttctcgtacttctgtatccaatgagtcctttagataccctttagcaagcaaccaatctacttcattacaaaataggaattataaagattggttaaatacattggaaggcgggaacaatcaaggattcattaacattgagggacggttgtctctagaacaagtacttgcagtttctgcgggagtcgcatcatatattctttcgaaccttggaccgtttggagtttttttctcctatatcataggcgcattttggccaactgctccaagtgatacaagagtttgggaagcttttatggaactaatagaagcacgtatcgatcaaaaaatacaagaaagtacaagaaaggatgcaatagcaaggttacaaggattaggagcggcatcggaagtttatcaggaatcattggaaagttggttggaaaatcagaatgatgcaagagcaatgagtgtagtcagacagcaatttgttgcctttgaacttgattttgttacggcaatgccattttttgaaaggtcaggtgatgaaatactattactagctgtgtatgcacaagctgccaatcttcatttactgttattgagggatgcttctttatatggggcagattggggaatggagccatacgacattgctaattactataaccgccaaaaagaaaggactgctacatattctaatcactgcatggaatggtataaaaagggtttagatgaattatggtcagccgggggatatggcggagatgtttggcaagattacaatgattttcggcgggaaatgactttaagtgtattagatttcgttgccttatttccaaattatgatacacatctgtatccgatagaagttaaaggtgaactgacgagagaaatttacacacctggcattaatatagatatagatagaggtaggttaggtaaagtaactcttgaaaatgcacttgtaaattcgccaagacttttttcatggttaaaagaaatacagttgtttacaaatattaactttaaccctagatggaagtttttgagtgcgactagaattggttataaattaacgggttatcggtctgtaaattttgagccatacgaaggcttctactttgaaggtcttttccaatcaaattttacactcaatgattatcaagagatatatatagttgatgtaacgcgttttggaagtttatatgatacccctactgctattacggcaatgacctttttcaaagatgataatacgaccttcaactattcgtccaatacgccaagtggggaaccaatgatcacttcaggtttctacttaccaggtatcgatggttcagaggagccaacttctaataattttagtcacagattaagtactattaatacatataatactacaaatcaaacattttatcatacatttggctggacacatgttagtgtggatagaaataatacgattgtttcaaataaaattactcaaattccatttgttaaagccaatacgggcaatgtagtaagaggtccggggcatacaggaggagatttagtagtttttaagccagcagcaagaccagatattgtacttagggtgggaaatactagattacaaagctaccgagtaagagtgagatatgcttctaatgcagatatctcactggaacttgatactacgtatgaaaagacgaatatacacctgcaaaaaacattcaattccagtgaggcggaagatctaacatatgataattttcaatacgcagaagctgataatatagtatggcttggacaggatctttctcagtatatagaattccaaaatgcaattaccaatgattcaacggctatagcttattttgaaagagtcgaattcctcccagtaggtgcaacttatgaagcggaacaagatttagagacagcaaagaaagtagtgaatgcgttatttacgaataccaaaaatgcattacagatgagtgtaacggattatgaggtaactcaggcggcgaacttagttgaatgtgtgtccgatgaattatttccaaatgaaaagcgattgttatttgatgcggtgaaagaggccaaacgactcagcgggatacgtaacctgcttcaagattcagatttccaagagataaacggagaaaatggatgggtgggaagtatagagattgagattagagaaggagatactctctttaaagggtattcgctacgtctaccaagtgcaagagagatttacatggaaatgtttccaacatatctgcatcaaaaaatagaggaatcacgattaaaaccgtatacgagatataggctcagaggttttgtaagcagcagccaagatttggagattttttcaattcgtcatgagacgaatcggattgtaaaaaatgtgtccgatgatttactaccgaatctatcttcctattatacttgtgggggagtgaatcgatgcagcacacaaaagtatgtgtataaccgtttagaattccaaaatagtttatcaagtggaaatcgttattctgatgcgcattcattctcaatcccaattgatacgggtaaaatcgatttgaatgataatacgggtatttggattgcatttaaattagctacaacgggcggatacgcaacacttggaaaccttgaattggtagaagaggcaccattaataggagatactttagagcgtgtgcaaagagaagatcaacaatggaaaagtcaaatgacaaggaaacgtgaagaagcagagagaaaatacatggctgccaaacaagcgatagatcgtttatatgcagattatcaagatcatcaattaaatccaaatgtagaaattacagatattacagcaacacaacatctcgtacagtctctaccatacgtaaataatgacgtattacaagaaataccaggaatgaactatacaaggtttacagaattaacaaatagactgcaacaagcatgggagttatatggccttcgaaatatgatagcaaatggagattttcgaaatggattaaatgattgggatgcgacatctggtgtgaatatccaacaaataaatcatacgtctgtcctcgtcatttcaaattgggatgcgcaaatttctaaacaattcacagttcaaccaaatcaaaaatatgtgttacgtgtgaccgtaagaaaagaaggaagcggagatggctacgtaacgatccgtgatggaggcaaccataccgaaacactgacatttaatacatgtgattatgagagaagtaacgtatataatgagaaagtattccaatcaaatgactatggtacaaacaatgtatatcatacgcaaacaacgaatgccaatcgatatactacaaatagtctgtataatgatggaactggctatgtcacgaaaacagtagaatttattccatatacagagcaagtctggatagagatgagtgaaacagaaggagtattttatgtagaaagtatagaatttatattagaagaagtg

SEQ ID NO: 54 - DNA, 3507 bp, Artificial Sequence
  stop codon replaced in axmi120
atgagtccaaataatcaaaatgaatatgaaataatagataccccttctcgtacttctgtatccaatgagtcctttagataccctttagcaagcaaccaatctacttcattacaaaataggaattataaagattggttaaatacattggaaggcgggaacaatcaaggattcattaacattgagggacggttgtctctagaacaagtacttgcagtttctgcgggagtcgcatcatatattctttcgaaccttggaccgtttggagtttttttctcctatatcataggcgcattttggccaactgctccaagtgatacaagagtttgggaagcttttatggaactaatagaagcacgtatcgatcaaaaaatacaagaaagtacaagaaaggatgcaatagcaaggttacaaggattaggagcggcatcggaagtttatcaggaatcattggaaagttggttggaaaatcagaatgatgcaagagcaatgagtgtagtcagacagcaatttgttgcctttgaacttgattttgttacggcaatgccattttttgaaaggtcaggtgatgaaatactattactagctgtgtatgcacaagctgccaatcttcatttactgttattgagggatgcttctttatatggggcagattggggaatggagccatacgacattgctaattactataaccgccaaaaagaaaggactgctacatattctaatcactgcatggaatggtataaaaagggtttagatgaattatggtcagccgggggatatggcggagatgtttggcaagattacaatgattttcggcgggaaatgactttaagtgtattagatttcgttgccttatttccaaattatgatacacatctgtatccgatagaagttaaaggtgaactgacgagagaaatttacacacctggcattaatatagatatagatagaggtaggttaggtaaagtaactcttgaaaatgcacttgtaaattcgccaagacttttttcatggttaaaagaaatacagttgtttacaaatattaactttaaccctagatggaagtttttgagtgcgactagaattggttataaattaacgggttatcggtctgtaaattttgagccatacgaaggcttctactttgaaggtcttttccaatcaaattttacactcaatgattatcaagagatatatatagttgatgtaacgcgttttggaagtttatatgatacccctactgctattacggcaatgacctttttcaaagatgataatacgaccttcaactattcgtccaatacgccaagtggggaaccaatgatcacttcaggtttctacttaccaggtatcgatggttcagaggagccaacttctaataattttagtcacagattaagtactattaatacatataatactacaaatcaaacattttatcatacatttggctggacacatgttagtgtggatagaaataatacgattgtttcaaataaaattactcaaattccatttgttaaagccaatacgggcaatgtagtaagaggtccggggcatacaggaggagatttagtagtttttaagccagcagcaagaccagatattgtacttagggtgggaaatactagattacaaagctaccgagtaagagtgagatatgcttctaatgcagatatctcactggaacttgatactacgtatgaaaagacgaatatacacctgcaaaaaacattcaattccagtgaggcggaagatctaacatatgataattttcaatacgcagaagctgataatatagtatggcttggacaggatctttctcagtatatagaattccaaaatgcaattaccaatgattcaacggctatagcttattttgaaagagtcgaattcctcccagtaggtgcaacttatgaagcggaacaagatttagagacagcaaagaaagtagtgaatgcgttatttacgaataccaaaaatgcattacagatgagtgtaacggattatgaggtaactcaggcggcgaacttagttgaatgtgtgtccgatgaattatttccaaatgaaaagcgattgttatttgatgcggtgaaagaggccaaacgactcagcgggatacgtaacctgcttcaagattcagatttccaagagataaacggagaaaatggatgggtgggaagtatagagattgagattagagaaggagatactctctttaaagggtattcgctacgtctaccaagtgcaagagagatttacatggaaatgtttccaacatatctgcatcaaaaaatagaggaatcacgattaaaaccgtatacgagatataggctcagaggttttgtaagcagcagccaagatttggagattttttcaattcgtcatgagacgaatcggattgtaaaaaatgtgtccgatgatttactaccgaatctatcttcctattatacttgtgggggagtgaatcgatgcagcacacaaaagtatgtgtataaccgtttagaattccaaaatagtttatcaagtggaaatcgttattctgatgcgcattcattctcaatcccaattgatacgggtaaaatcgatttgaatgataatacgggtatttggattgcatttaaattagctacaacgggcggatacgcaacacttggaaaccttgaattggtagaagaggcaccattaataggagatactttagagcgtgtgcaaagagaagatcaacaatggaaaagtcaaatgacaaggaaacgtgaagaagcagagagaaaatacatggctgccaaacaagcgatagatcgtttatatgcagattatcaagatcatcaattaaatccaaatgtagaaattacagatattacagcaacacaacatctcgtacagtctctaccatacgtaaataatgacgtattacaagaaataccaggaatgaactatacaaggtttacagaattaacaaatagactgcaacaagcatgggagttatatggccttcgaaatatgatagcaaatggagattttcgaaatggattaaatgattgggatgcgacatctggtgtgaatatccaacaaataaatcatacgtctgtcctcgtcatttcaaattgggatgcgcaaatttctaaacaattcacagttcaaccaaatcaaaaatatgtgttacgtgtgaccgtaagaaaagaaggaagcggagatggctacgtaacgatccgtgatggaggcaaccataccgaaacactgacatttaatacatgtgattatgagagaagtaacgtatataatgagaaagtattccaatcaaatgactatggtacaaacaatgtatatcatacgcaaacaacgaatgccaatcgatatactacaaatagtctgtataatgatggaactggctatgtcacgaaaacagtagaatttattccatatacagagcaagtctggatagagatgagtgaaacagaaggagtattttatgtagaaagtatagaatttatattagaagaagtg

SEQ ID NO: 55 - DNA, 1155 bp, Bacillus thuringiensis
atgtttaatatcaaatattccacttcacaaaggaaattaaatttaataaaagcactttttaaaaatggtatattatctgtatacacaaatatatatgtgtgtgaaagatttaatttaaatttttcagtaaaagaagggattggttatatgaaaaataataaaagattaagaaaaaaaatactagcttttggagcaatcgcatctattggaacaacacttgtaacggcatcacccttagtgatatccgccaaaacagaatataataacgagcaacaattgattacgcaaatcaaccagaaggaaaatagtttccctaacgtagcactaggtactcagtggcttttctcatactatgataaatatttaagagcaaatggattaattcgtgcagccccatttgtgactgtgaaagatttagaggttaaaaattcttatggccaattagcaatggaaccccaagtaatgagtactactccactttgggctggacaaagtgatttagaaaatacaactgaccgtgaacaaactttgaactcaatggaatttcgtaaaacttattccaacactactagttcttctacagaacatggatttatgctagggactgaaaccactgtcaaaactggtataccctttctagcagaaggaaatatcaccttaaaagcagaatataattttaatgatacacaggggtatgaaacttctgaaactgtagagtatgtagctccatctcaacaagttattgttccgccccaaacaatcgctcgtataacggcaacattagatgttaaaaaaattaaaggtaaaatggacctttattcagaaattggtttaaataaagaagaatatggttatgataaaatcccaacgtatcatgtatttgaaggaatgaaagatccgataactcttggatctatttatgacgatgcctacaagcaagcacaaaaagatggatttagtgaaatacctgagattaaatctttatcaagaagtttcaataatcccgattactttttagctagtggagtaggaagttttgaatcagaatacggtagtgttttcaatgttaaagttgaatatataaatataaaaaccaaaaagattgaaaaaacagaaaatatagttgtacaacctaaaattaattcactaaaagaa

SEQ ID NO: 56 - DNA, 999 bp, Bacillus thuringiensis
atgtaccaaatgaaaaataataaaaaaattaggaaaaaatttttagctcttagtgcaatagcatctataggagtaacgtttgctactatatctccagaattgacaagtgctgctcaacttgatacaattcaaaaaacctcttccattaatgaatttgcaggtgaaacaaaaacaatacaagactggcaaactcctttgactgaagctgaactagtttttggaaagcatttagatagtcagagagaatatagaacgtcgatcggcgatgctaaatatcatatgaaggatattaagtttcatagtaatgcagtatcaccagatggcccacctaactttactgatgtaggggatgtatttgtaggacacgcaactttaaacaacgatcttgatgaaaaaatagatttaaaaacagatagtttctcaagaacgcttacagattctgttactacttctaccacacatgggtttaagattggagagaaaactagtggtaaaatatcttttcccataggcgaaatgtcgcaggaactctctctagaatataatttttctactacggatagtcaaacaaatacagatagtaggacttatacaattccttcacaaactattcctgtcaaaccccattcttctgttgaagtaattgttatgttaaaaagaagtaaggctacagggaatgtaaacctcttaactaaaatgtcaggaagagttgacaattggaatcactgttattatcctttacctggtgaacagtatggtaagaattatgtacatagcggttctatcgctagtatggttaaatatgcaaaaaatttcgagaaacttccaaatttatctgtgaacttagatgatacaatcaatttaattggtaaaggtacttatgaagctgaatttggtacagaatattcggtaactgtaagaccaattgataaaaaaggaaaatatacaggggcagattacacatataccgttaagccagaagttacaaaagcagaagcg

SEQ ID NO: 57 - DNA, 912 bp, Bacillus thuringiensis
atgactcttactatgtctattatcgatattaaaaaagatgtgattgatcatgcaaaatggaacgcaagtacgtattataacgcaaatcctgataccttttgtgaggaaacaatctatgatttttcagtttttgatttaaaagtagaaccaacagtcacagccattgatgttaggcctacactgcgtgtatctatctctaaaacaatagagaatccaacatcgcagtctcaatttagggaagtttcctttactgaaaacgtaaaaaatacatacactacctatacgaaagagggatttctattacaaaatcctattactgaaatacactcttttccgattacactcacatttgatatgtatacggtgaaacaaaaaataaatgtaaatgtgccaggggagtatcattatagtagtttagatccaattacgatgacacgagaacgtttatgggaactgacatctgctatttcgattcctccgaaaacaagggtaacagctactcttatggtatataaaggtactttcaatgtacctattcgcttacacgcaacgatacgtggagcgtatgcatataatggtcgttattacgccaattctgtacaatatgcagattggtttcaaaaacaacatattgcttttcatacagcttcttctttatttattgataaggaccaatgggcaggatataaaacaatgtatgtatccgctagcaaggacgatgattctttacatataaacggaagtggcatcaataaagttacttgttgtttatacgctataatacacttcgaggaaaaaagtatgttttataaccaaatggtaaagaaagaatatgattcacctatttattttgcaaatacaatgcttcaaccaggtatgcttggaaatgaaattcctattatcaatccaatt

SEQ ID NO: 58 - DNA, 3297 bp, Bacillus thuringiensis
atggaaaactcaccaaggaattatcctatttcatatactacatcatcaacccaagaggaaaattttcaatttatatcaaaattagataggaagattgaactattaaataagcttaaattaggattaactacaggacaatatttagatattattttagagatatttaaagatataaaagcacggaaaattgactatctatcatttattaatataagtttacctcttataactataggtgttcctaaagtaggaattacagtcccttttcttagtttatttttccctaaaacatctggaattttctcaacagtggaaattccagatgtttttacgataattaaacaagatatacaaaatatattcaagctaattttaacagatgagcaaataaataatttaaataccatggtactaaaattagaagtatcaatgaaaaattatatagatatattaaatggaattaaatcgaatcctactaattttttcgcaatatacaataatacagatacaataattacagaaattatagatgaatttataaaatttaattataccgaattgcatattacttatttttcagtatttgccactatacatcttatgatgcatagagatgtaattatacatggggaaaaatggggatttacagaagattttataaatcaaaaaaaagctgatataaaaaaaatgattcaaagatatatttccattggcgatatattatttgaaaggggtttgaataaacttctgaataatgaacaaacacataatggaattgatagttgtattcaaaagctagctctgtatggccctaatatttataggttatggcccactctagatcctgacacatatccggtgtatactcaaattgaacaaaaaagagtattatttaactctgatataacacgagatacaaaaaatcaggataaaattaacattgcagaagataatgagggaatattcaatcaatataaacattctactactctagataatatagatgtttgcaaagaaaaccttatttataatactagcattgattttaatagaaacggactcaataataaatgttttagtcacaatattattggagatattgattcaggtaaagatacattcttatcaaaaatcaaaggggttgtagttgcaaattacagtaataatcaaggtgacttggtaacagaatggattaatggaggaagtacagtaaaactaggccaaacacaaattgttgctataccaattacagtgttagataatcatgtatatcaaattcgtttacgttatgcaacagagaaccatgtaggagctaatatgtggatgtgtattcagaataaccaaactggtgacacacccttaaatacaaaactatcatttgcagctccaatagattctaattctataaaaggcaagtatggaaaatatattttaaatataatagaaaatgattgtgagaataaagacataactttaaatgcaggatcatatacaattttcatcaaaaatataatggaaaagaatctctttttggatagaattgagttctataaaaatacaattaaaaataatacgttaataatacttccagcacgagaattagtttccccttcaggcggtggacctggttggactaatctttgggttgctgaaacaaatcaaattggtaaggcctttgaagcagagaattcagttagtaaaggcgagtataagttttacttcaatggtactttagttggtagtactcaaggaaatacattctatgaaaactttgatacagttcaaatttatttttataattgtgtagtggatatatttaattcctttactggtgcaaatatttggattgaaaagccttctcaagaatattttaaaagtaatttggatttagaaagaatcaggaaacaggtaaattctttattcataggaaaccttcataagaaacttagtcctaataccacagattatttgattgatcaagttgctttaaaaattaatgttttatccaatgaaatttttgggaaagagaagatggaattacgtaagttagtcaatcacgcaaaacacttaagtaaagcccgaaacttgcttgttggtgggaattttgagaatctagataactggtatttaggaagatcggttatacaaatagaaggaggtaaaggatatcatttattacttccgccacctattgattatctaagttatgcatatcaaaaaattgataagtccaaattaaaacaaaatactcgatatattgttactggtttcattgcacaagctatttctttaaacatcatcgtatcttgttatgaaaatgaaattaatcaggtccttaatgtcccatatgcggaagtatttcctatccactcagaagcaataaccggtgtttgtatatctaatcttccttttaaatttaacaataaaaaaggagtagattctcatttgtttcgttatagtattcatgtcggttccctacaaacagaatccaatctcggaattgaattaggtctacgtatcacaagtcctacaggttttgccaaattaaataatatagaaatatatgaagatcgtcccttaacaaacaatgaaatatctagaatagagcgtacagaacataaatggaaaaaagtatttattcaatctcaaacggacatgtctgcaaaactgcaacctgttatacatcaaattaataatttgtatcaaaataaagattggaacgaatcaattaaatcgactgttatgtttcaagatgtgcaagctattaaattaccagatttaccaagggaaacccattggttaatggcggatcgtaccgatgtacattatgcaattatgcaacaaatgaagagagctatacatcatgctttttcacaattaaatgaaagaaatcttcttctgaatggaaattttgcagagggattaattaattggataccagaaggggattgtcagattgttttgtcggaaaatcaaaataaagctgtttctctattacattgggatgcaagtatcacgcaatcattaaagattactaattttaatccggatcaagaatatcaacttcgtgtatatgggaaaggaaatggaaccctcatgatacagcatggtaataaaatagaatctatgagtttttccagtcaggtatttatgtcaaaaccaagtcattatatagttttagagacagctactattgaggtatatattgtatctgaagggacagaatttataattgataatgttcaattaacccaaatatctagagaagaaattgatgattttgatccaaacattgta

SEQ ID NO: 59 - DNA, 2019 bp, Bacillus thuringiensis
atgaataataatgaatatgaaattattgatttacatgcttcactttattcttcaaatagaaatattaataattctagatacccttacacaaataatccaaatcgatcattacaaaacacaaattataaggattggatgaatatgtgtcaacagaatcaacaatatggtgagaattctcaaacttttgctagtgctgagacaattgccgcagttagtgcaggttctattgtagtaggcactatattaggagctatggcttttccccctttaggagctgctgctattatatctttcggaacaatactgccgattatttgggcaccaggtcaagatgctagaacagtatggaaatcctttttaacaattggaaatcgaccttttggtttaccagtagatgaagctatagttagcttactatatggtcgagttcaggccttaagagtcgaagttgaagactatcaaaggtattttgatatatggtatgcaaatccgattccacaaaatgctagtccattaaaatcaaaatttcttacgttagatactcttataataggagcattagaagaattaacaaaagattattctataacattacttcctggttatgcacaagtagcttcttggcatttaatgctattaaaacatgctgcagtttattatgacagatgggcagcttcatctaacttatcaatacaaagtatatatcctcaggattatactagcaatcttcagacttgtttaacgaattgtgcaaaagaaagtgagaataaggtgagttctaaatattataagtgcattttaaaatgtagaattaatgaatatattaattattgttcaacaaaatatcaagaaggcttaaatagacttaaaaattcaagtggtataaactggaatatatataatacgtatcgtagagaaatgactctaactgtattagatcttattgctacttttccaaattttgaccctgaaaaatatacaatagctactaattcacaacttactagagaaatttatactgaagctttacttcaggaacctggtattccaagacctattaatgaaagagaatcccagttaacaagacctgaaggtttattcactcatctagatttattacaatttcatacgcagataaactctgattttgtaccaatacgtggattacgtggtgttcaaaacttcatgtcatttataggtggtaataccttcaatggtccaattcatcaaccagcaactccaccatcatcttatatagagattattcgagaacaaccactcaatgttagcggagagtctaatcaaatttataaaatatcagtcacacaggctccgtcatcatatagaacaacatctatagattttaatttaattaatggaagtacacgtcaatatcgttcaggatctagtcatgtaggatcagaaataactatttttgaattcccgaaattccccaaagacaaaattcctccaaaccgttctgagtatagtcatgtagtatcttatgtgaaagtcggtcctgaagaaaccccgggcgtaatattttatacacaattatcattcgcttggacacatacaagtgttgattttaacaatataatttataataaaagtattacacaaattcccgctgtgaaagcttatgaattaagcaccgactcaaaagttgtaaaaggtcccggtcacactgggggcgaccttgttgaattgaaagactatatgttttttaagctcttagttcctcaaggttccgtagggtcatataaagtgcgtattcgttatgcttctaatgctccgaaccaaaatataggcttaacaaggggtttttatcaagatcaaagtttacctcaaacttttaatcactctaattacaacgatttaaaatatagtgattttcaatacgcaacatttccactgccagtgacatatacaggagcattaacagatactatatcattacatggcctaagaaataatccaaatcgtatatttatagacaaaattgaattcattcccaat

SEQ ID NO: 60 - DNA, 1626 bp, Bacillus thuringiensis
gtgagtcctatgtttacaagtagtacgaaaaatacgttaaaaatagaaacgacagattatcaaatagatcaagcggccatttcgatagaatgtatgtcagatggacaaaattcacaggaaaaaatgatgttatgggatgaagtaaaacgggcaaaacaactgagtcaatctcgtaatttactctataatggagattttgaagactcatcaaatggttggacaacaagtgatcgtattaccattcaaacgaataatcctatttttaaaggacattatctcaatatgtctggggcaagaaatattgatgggagtatattcccaacctatatctatcaaaaaatagaggaatccaaattaaaaccctatacacgttatcgagtaagagggtttgtgggaagtagtaaagatctgaaattaatggtaacacgttacggaaaagaaattgatgccatgatagatgttccaaatgatttggcctatatgcaaccaagtccttcatgtggagattatcgctgtgaatcatcgtcccagtatgtgagccatgggtatcctacaccaacagatggatatgcttctgataggtatgcatgccagtccgagcgaggtaaaaagcatgtgaagtgtcacgatcgtcatccatttgattttcatattgacaccggagaagtaggtacaaatacaaacgtaggtatggatgtcttgtttaaaatttctaatccagatggatacgctacagtagggaatctagaagtcgttgaagaaggaccactaacaggcgacgcattggcacatgtgaaacataaggaaaagaaatggcatcaacatatggagaaaaaacgttgggaaacacaacaggcctatgagccagcaaaacaggctgtagatgcattatttacaaatgaacaagagttacactatcatattactttagatcatattcaaaacgctgatcgactgatacaggcgattccctatgtataccatgcttggttaccgaatgctccaggtatgaactatgatgtatatcaagggttaaacgcgcgtatcatgcaagcacgctatttatataatgcacggaatgtcataacaaatggtgactttacacaggggttaacgggatggcacgtaacaggaaaggcaacggtacaacaaatgaatggcgcttctgtattagttctatcaaattggagtgtgggggtatctcaaaacttgcatgtccaagaccatcatggatatgtgctacgtgtgattgccaaaaaagaaggacctggaaaagggtatgtaacgatgatggattgtaatggcaatcaggaaacactgaagttcacttcttgtgaagaaggatatatgacaaaaacagtagaggtattcccagaaagtgatcgtgtacgaatagagattggagaaaccgaaggtacgttttatatagatagcatcgagttgatttgtatgaaaggctatactagcaataataatccgcacacgggtaatatgtatgagcaagaatatacaaacaactataaccaagactctagtagtatgtataatcaaaattatactaacaatgatgaccagcattccggttgcacatgtaaccaagggcataactctggctgtacatgtaat

SEQ ID NO: 61 - protein, 560 aa, Bacillus thuringiensis
MYINKMKNKLKLETTDYEIDQAAISIECMSDEQNPQGKMMLWEDIKQAKQLSQSRNLLQNGDLGDFYGSNWTFGNDIIIGSNNPIFKGKFLQMRGARDVYGTIFPTYIYQKIEESKLKPYTRYRVRGFVGSSKDLKLMVTRYGKEIDAIMDVPNDLVYTQPNPSCGDYRCESSSQYMNQGYPTPVIDGYASNRYACPSNRGKKHVKCHDRHPFDFHIDTGEVDTNTNVGIDVLFKISNPDGYATLGNLEVIEERPLTDEALAHVKQKEKKWNQHIEKARMETQQAYDPAKQAVDALFTNAQGEELHYHITLDHIQNANQLVQSIPYVHHAWLPDAPGMNYDGYQGLNARIMQAYNLYAARNVITNGDFTQGLQGWHVTGKAAVQQMDGASVLVLSNWSAGVSQNLHVQDHHGYVLRVIAKKEGPGKGYVTMMDCNGNQKTLKFTSCEEGYMTKTVEVFPENDRVRIEIGETEGIFYIDSIELLCMQGYTSNNNPHTGNRYEQSYNGNYNQNTSDMYEQEYSSNYNQDSSSMYNQNYTNNDDQYSGCTCNQGHNSDCTCNR

SEQ ID NO: 62 - protein, 537 aa, Bacillus thuringiensis
MFRSGAKHTLKIETTDYELDQVAISIECMPDEQNPQKKLMLWDEIKQAKQLSRSRNLLHNGDFEDLFRGWTTSAHITIQANNLIFKGNYLNIPGAEDIDGTLFSTYVYQKIDESKLKPYTRYRVRGFMGSSKDLKLVITRYGKEIDASMNVPNDLAYMQPSSSCGDYRCESASQYVSQGYPTPVTDGYASDMYACPSNLDRRHVKCHDRHPFDFHIDTGEVDTNTNVGIDVLFKISNPDGYATLGNLEVIEEGALTGEALAHVKHKEKKWNQHMEKKRMETQQAYDLAKQAVDGLFTSTQELQYHITLDYIKNADQLVQSIPYVHHDWLPDAPGMNYDLYNNLKVRIEQARYLYDARNAITNGDFTQGLQGWHATGNAAVQQMDGALVLVLSNWSAGVSQNLHAQDHHGYMLRVIAKKEGPGKGYVTMMDCNGKQETLKFTSCEEGYMTKTVEVFPESDRVRIEIGETEGTFYIDSIELLCMQGYDNNNNPHTGNMYEQSYNGNYNQNYTNNDDLHSGCTCNQGHNSGCTCNQGYNR

SEQ ID NO: 63 - protein, 1339 aa, Bacillus thuringiensis
MALTPYYLSDDTIDTHNPNWMKDMDDYVLLSQISIPGTHETMAKNPWGHDILPGNNFIGVCQSLSLSAQLNAGIRYIDIRCYYESSKSDAGISAPSFSIHHEVINENKALGADVLSVVVSFLQNNPSETILMRIKQEKTKESDTTFSNTFQKYVDQYKSYFWDSNNQTSIPKLGEVRGKIVVLYDIGDHKFGLPYSDPRLFCTQDNYSFSTNWHQYTKWEEVKTHLTQADEQYQSNQEDPQNNILKSAIFLNYLSGSGNLTYPFFVASGHVDPGTNGGRLWTGLTTLTSKHKWPDFPRLNGFLGLYSIYFEGINNLCGDRLEDYRYVGIVAADFPGAGLIEKIIEINKTHPPQILKVAPPESMTISKTYQLSDNEGQKVLWNNTDFNQNPQGIFIEFNNSGIESELMFLKDGTTVSSFSTNIDVISHKILTLEFDTIVVNLPNNSKSSSGTISATLYYYKSPWASTSKTDTIPISNSFTFNNKTELWYNNILSPAKGLRMTGSILYENQPKSDFFPLQIQLLKDEKLVETLVPYVLTPSQHKADEPIDFIVCSDQEFDQMIVWKLIALGFSDDIGDLTLNYSGEISYIPMEYSNTVFKKIHELTTTPQVLWKNTLPGKLGEYVTINGFRNIMNNWSFNPASSLETGGIAMKFLKSGKEIITLNDILSIQNPKRNERYSKIYNDNYISLHVPEGFDEIQVATFMNADSLLMYEELTGKVFLNDEGVFSSPNPSLYINKEYNTPNTTILWEAPLNNQNQIQMGNQAHFFIENTPEPTKLQFQFIKNEQIIYSVENIIEVEGNPPQITNEIIVIPTNVSNGFDTIQFTPIDPTFNGLIVGSVEVLSPSQNTVNETKIEHSLSLSEKSKSIFYTSKELEQITALTQKLFISVKEDILADDVTDYQINQVALKIDGLSAENFLVEKQQLERKIQQAKRLSQRRNLLQYGNFESTEPWIFSSHATILDSNDLFPQPFLTLTSTLTPDKNPTYAYQQIPKNRLKPYTRYIVRGFIAKSTELDILLSCDSTIIKQQLNVPTAKVQQISIENGNCCAQAGCIYADGTVTDSHWFTYTIDTGSLQQNSDVGLELCFKLTTEKGNAQIGNVEIIEERLLTEKEKQKKQQKEKKWVKQKQIKMREMRKILDIMHEDIASLYDMKMNLKLDVSHQDIQNVYIPHANSLEGVYLSMVPDQPGPYYEEYQLLASLKRYARRVYRNRNKISNGTFQYDLLDWKPKGNVDVQIEKKHSVLQLLDSGAMVSQLVQLPIENVKGEEISYLLRIHAQGNGKVTILHGEEVTVLPFTNSDEQVQMIEWYPSTNEVQLEISSKSGKVIVSSIEILGFCCKV

SEQ ID NO: 64 - protein, 394 aa, Bacillus thuringiensis
MFFLTVQKKTIDPQLNTTINSFLNKYVVIKNVSNQKVLSARFGNGYVEAGPETDDDRQKFIIFQLDNNVFLIGGKETGRKITCDHNSYETAILAYSDYDLAQLPDNAFVNSHWILKNVKDNIFNMINKEFYLYLSSQPQFPTGSFGIWGFTDSATGSTNEQFEFLPQEETINIPTAPSLEKLDPFPKYTSFTDNLPDETPHRLTGWTKIPYLIVKDNEVPSEFKIDMAPYYVIKKYQYWKKIETLSLAPGESRSTSYTYGTTTTTTTNMEKRIDMTINEDGGIKFNLTKINLGITGDMKKTITDNLDIRESSTTRVMNSTTETDDQRNPFTTKPLVYSRYILTTELQYIRPSQNKYDPDILIDSWTFTDHQTMKITSFPSREEISAELNKLKIK

SEQ ID NO: 65 - protein, 354 aa, Bacillus thuringiensis
MTNPIQPKKYINLQDTLKHKLIQIHDSSGKTLTVNSTETYGFNNLYLYDGPLNSDHNWIAYPLGEGIYMFVHILTGKILTHPDIYLQSKAMDYIGDTTQLWTLETVKDNNHFYYIRNFYCGSNVALKRDTDFIMWSITATDDIDISDTFPTLETLDSYPQYTNIDDNLPSTTPDRLISFTLLPAPTVKDNQLTTKQKVQITPYYLMEKHQYWTKLQDFSIAPGAELTKQYTYGMDTNQVNEMTKTTGITINTDFGVNFSPGGILEANGSYKKQITNDLKLHESQTTDVAETTTKTSKFDNSNNTYTIHYAKYILTTRLVLKQFNSNNSNITIGDWSFSDPNTIQTTSLIPDMLK

SEQ ID NO: 66 - protein, 400 aa, Bacillus thuringiensis
MRNVLFYLYLFYKEQRCIQVNNQQTSLDLNDNNIFENNIITIKNYKTNQVIGYTSLQDMIPLEPQADTDKQQFLFFRLDGGKYLITHTFSGDVIQGVRGGLLPPHYKKEWVTADIFVYHGNVDPEIRLSPHWIIKNTDIPNTYQLLNTQWGLYLVPYDQGYGSNYLGAIIKGNDDPHTYWTFQSIATLQPIIRPKLERLHAFPQYKQVNEKLTFETAHQLIGWTLLPYVFVKDHQLENKKRINLSPYYILEKYQYWKCIEHISLGPGETKTSSYTYGTTSIIQQTLEAHLGIIISQDGGLLFKNNRLTPHRGITFDIKKKIMKDLHIHEAITDIPMKSITTEYEHKNPFQTKLFSYMKYILATKFVLKRVSQNEHDPNIEVNEWTFTDGNTIKITSYPPF

SEQ ID NO: 67 - protein, 366 aa, Bacillus thuringiensis
MILDILKKTKYLDFLKKIKNIFFKIRNNRGEVMIGLGNNERVSYKKNSLCGNDNWIIYPLDNGKYVIANLLYGGVLDVQYRNENLIVYMNKYMSLPQQHWSLETVDTHLAYYKIRNLDVGMIIGKHIYDDTIYANYTDIDDENYHWTFEEAGVIHLPIKPRLEQVDTFPQYANQNNDLPIKTQHRLIGWTLIPSIMVQETVPLIQPLQELPYYILEKYQYWMKLYDIALLPKEKRTITYTYGITETMQNSLTEQIGITIHTDSGVSFLLDRPGKIYPIKKQIIRDLKISESQTEKKMIAKTEAITYQNPFVSDFLYCAKYILTTELILKYIVRSNGNPNVEINKCIYTDPQTIQTTIYSKSEKIEI

SEQ ID NO: 68 - protein, 1286 aa, Bacillus thuringiensis
MRCDTYKLIGGQFMNQYYGNNEMEVLDLKMGRSMYPYAQNSRSELQSMDYKEWLHMCERNDGLYPGTLASTKDIITTSLDIVGTILGFIPIVGGPISAGVSILSSVIGLLWPEPTPEEPQIDPQAIWIQFMEKVEVLIDQEIAKEAYNAAIGRLTGLKRALNLYQVAFELWVQDPTDPELKETLRIEFLNARSEMVSTIETFRYTGQEINLLTVFAQAADLHLLLLREGIMYGVQWGFDERTVESFYSNSQGEGLKDLLPQYTDYCTYWYNEGLQITYTLKPDLSDTERYPWATGKPDWNQRVLEELEGWNLFNDWRRDVTIMALDLVALWPTYDLGYYNNLEYGVTTELTRPVYSRASGTSWGSILTRDQYEQGIVRSPHLVTWLNSVDFHLNPGPFNASNSYKHYTGLKMKYYYSGLDYTIYESPLIGATSYSKKTINVEAKYNNDMFQADVKHDDAVYTMDFFKNNGNIEKIGYPRDPNYSTLSWPPETNISNYDHQMTWISGPAVNNTIPAFGIEWVHNSSSPFNYIAESTIENPIITQMPAVKAETLNGNASVIKGPGSTGGDLVSVSPGASVVIRLTGTTQPAYQVRLRYVSQGAGQLWMSRDFYQDGGWGNNYATPFDVPATTSDESLTYNSFDYVVAPGQITYPSSTDWRMTFYNSGKTIIIMDKIEFIPIQENVAEYEAQQNLEKAWKAVNALFTNDTKNALRLDITDYDVDQAANKVDCMSDDIFTKEKMILLDQVKQAKRLSQARNLLNVGDFESPDWSDENGWKVSNNVTVQSDYPISRGRYLNMPGARVIEFSDTLYPTYAYQKIDESQLKPYTRYLVRGFVESSKKLELLVTRYGKDIYTEMNVPSYQVINSQGVRMLNSCGTKQVSSYTIPPTMPSDPCQNVYATNTSSLMIPSTNGLCEDKQHFLFHVDVGELDMRANPGIEFGLKLSSPEGMAKLDNLEVIEANPLTGEALARVKKREQKWRKEMKQKCALTEKAVTSATQAVDSLFTNTQKVKLKSTTNMQSIENAEAKVDAIPYIHHPEFEDLSGMNTMIFQQLQSTIMTAMNLYGRRNVIRNGDFSGGLSNWSVTDGVDVEVKDGKFPVLVISQWDANVSQDVCVQPEHGYVLRVTARKEGAGKGYVTISDCTEENTETITFTSNERFMTERSPVTVPTSAVCDITDSYGTGTSPYNQNTMGNGYAESLDRISCSCGNGSEPCTCGSNMRNNLSGRNGTKSYTSTQRIPNRDASLPSAYITKTIEMFPETNRIRIEIGETQGTFLVESIELVCMEE

SEQ ID NO: 69 - protein, 917 aa, Bacillus thuringiensis
MIFVIPNRDQFFKITGKQSGKVMSVDEQSTSNNAHIDQYDWVYQNNQKWLFIPLNNNYYAIVNENSGLVMSVDQQSTANNALIDQYEWHGDESQQWFLKDLENGYNGIQARHSGKFASVDQQSTANNAYIDQYPWVDQNNQMWSLETVESFTLPAIMTYPLAPPPQYSSMGETLPDHTESLPTNYTLAPCIAVEDPYYNNQQKIQTGNEYYLYVRKQYWKKVASHTLAPGESYGYKQISGMTTTDQTTVTKTVSHSFGADVGLKFRKDSVSAGLSYQYSEELSVQESRSETELSVVEEAFTLENPNNYQISWTKYILVSEYSVQRADGTLVNEPWTVTDYHNTYSSFYPLGSDIIEQRVSVGIIDAQQAVYNLFADAQHSRLKIDTTDYMIDQTAFQVEQLSDETYAYEKMMLFNLVRCAKQLSVKRNLLHYGDFESPNWQNQEDGWQASSNVTVLSDNPVFKGRYANMPGAKNTASTYLYQKVDESKLKPYTRYLVRGFVGSSKELELFVTRYGKEVHRKMNIPMNTCSCSMGQVADYTMSNDPCQLYPSGMTLSSTEGLCEDKQHFVFQIDVGEIYQRADLGIGVGFKISSSDGMAQLDNIEVIEANPLTGEALARVKKREQKWKRELEQKCALTEKTVSSATQAVDSLFTNAQKNRLKATTTIQDILGAEAKIKAIPYVYNSYFEEVPGMNYTIFQALQSDVYNASSLYRIRNLIRNGDFSSGLSNWHATAGADVQERDGKSHVLVLSQWDATVSQEVCVQPERGYVLRVTARKGGSGKGYVTLTDCTADNTETVTFRSDDMASTPRPSVPQRPIEPAICDIPRYNESFGIVPEMNPVMNEQPESYGTTSCSCGCGNRIQTPSTPRMPNVTGSSPGYLTKTIEMFPETNRLRIEIGETEGTFLVESIELICMED

SEQ ID NO: 70 - protein, 1237 aa, Bacillus thuringiensis
MNQNYNNNEYEIRDTDTMCYQSRYPLANAPGSELQQMNYKDWMDSCTLEEQVELFRDTSTTVRDALTTTAGIIAALLSVSNPVSAAAAGIIALLIPQLWPSGSDEVTWEKFMAASEILIQKQITEAVRNKALSELEGMYRTIRLYELAAEDWNRNKNDPEAKERIRTQFRATNTVIEFAMPAFRVAGFEVPLLNVYAQAANLQLTLLRDAVKFGYDWGLPQDEVDDIYSEQLIPRISEHTDHCVRYFNIGVEEAKKLKANLDDYARYPWAQYINHGKIQGIENWNLFNDYRRNMTILVLDVVALWPTYDPKRYSIVTKSELTRELYTSVRGAFYGSTGDYNQDLEEIERNIISPPGLVLWPIESIVYTQNHTYYPMAGLQTRSYYSNSYTYQDSPVIGVTGTPNRINFDRADPFILTVTIIGFGQLGTSLGIYTMDFVKVSGSHRKVGNIEVGTDGYIDIPDRIPVGDNPPNTLSWMSAGATTLGITTFLQYVGYAWMHPSVDFSNRISLDKITQIPAVKGRSLTGTAKVIKGPGSTGGDLVALSAYDLLSIAVSLPANDTVFYKLRIRYASSQFARVQMSFTGPLEDGEATFDFPATYSGGNLTYNSFEYITTFAINSQSEEQFVEIQFVNFNEVDFIIDKLEFIPIEGSLEENEADQGLEKARKAVKALFTNDAKNALKLNITDYTVDQAANLVECVSEDFHAQEKMILLNQVKFAKGLSQTRNLLNHGDFESPDWSGENGWRTSHHVSVRSDNPIFKGRYLHMPGAMSPQFSNNIYPTYVYQKVDESKLKSYTRYLVRGFVGNSKDLELLVERYGKDIHVEMDVPNDIPYSLPMNECGGVDRCRPVSYQARSSHACTCSDTAVTHTDCQCKDKGNRTLTNMYTNVPTDRAVYRNGSHDHKSCGCKNNDMYRSETHPHKSCGCKDPHVFTYHIDTGCVDQEENLGLWFALKIASENGVANIDNLEIIEAQPLTGEALVRVKKREQKWKQEMAKKRLETEKAVQAAQGAIQNLFINAQQNRLKFETLFHQIVHAEMLVQQIPYVYHPFLSGALPAVPGMNFEIVQQLSATIGNARALYEQRNLVQNGTFSLGTGSWNVTEGVKVQPLQNTSVLVLSEWIHEASQQVRIDPNRGYVLRVTARKEGAGKGTVTMSDCADYTETLTFTSCDFNTSGSQTMSISTLSGFVTKTLEIFPDTDRIRIDIGETEGTFKIESVELICMEQMENHLYDMAGNLEE

SEQ ID NO: 71 - protein, 354 aa, Bacillus thuringiensis
MMVKRDISPRDLGGKEDSPFLLSKEEWITIQKYTGDGAYVPVNEAEMRKALALSASDEMPDFNELYSVYTNVKNHCQNWTDNTYREVLGVANEIVNYSRRAKVYYKPLIDYLPAIIDGDTEALEMFKKICERLAREAAEFRDHAGSLATMIGTFATDTANDYQSLKVVKDKYDEKYGDHSDEVKQLRASVERLREDLEEYMDEYEDYQSQSWLSLLLGPIFGFVLKGILDSTKGKALKARIDATKQQIEESDKIIQRNVYLMSLLDKTDTGTDKIQEQMAAALPIIQKIHGIWNSLHSDLDELSKIVMEDIHDDPEFADLGVELAIMQWEAVGKQADDFRVNADVGFVVEQYTA

SEQ ID NO: 72 - protein, 1349 aa, Bacillus thuringiensis
MYLNVVSSVYHTMRSIAIMLLFQILKCSHCKNMAVTCCNLQERLNLNTFHMHKASGSYLYSLHIQDKRPHIRNIRGGLYMNLNDNKNEFEIMDNGNMAYQPRYPLANAPGSELQAMNYKDWIDMYERSTNGNMLLQNMGATLGVALAVTAFILSVSFPVASAAVGIVSLLMPMYWPSSSGNSQDVWKNFMDSAEALMDQKIAYQKRQSAVLQLQVVQSRLKDYQQAVCNLKRDPNNENYKSLVRDAFDDADDSLKEVMINFGAESDEVLLLNSYAQAANLHLLLLRDVVKFGRDWGMKELQVEQYYDNPPNRPGNPGMVQLLAIYTDHCTRWYQEGAQVQYNTLDWNKFNDYRRDMTIMVLDIVSIWPTYDPFYYEYPAKIQLTRKVYTRVFGEYPKNRIDEVEWMVPTPRLFLWLDKLTFYRRNEELGQYAGITQRFKTTFDSQSLDYTQGMQTDLFDVVEINSGQINNRLSLNGVWKTSNVLGQYSGAATVQTFSFYLLQSEDPYNPITLGNVYNTISNTTYGLPCSTNTTGCTSNPCEPCNLSTSQESVCDIPGRITHTLATVNCGGWYENLRYFAYSWAHISVTVNNVITPSKTITQIPAVKAYNTTGNVISGTQSTGGDLVELPANSSLQMILTHLPGDKISGYRMRIRYAAKQPVTILVGHSSDFGEKLSSFELPATYSGGSLTYNAFGYKETLTILSQQVEYIGFVGFRSTNATVIIDKIEFIPIEGSVEEYEANQDVEKARKAVNALFTNDAKNALKLNVTDYAVVQAANLVECVPDEFHTQEKMILLDQVKFAKRLSQARNLLNYGDFESSDWSGENGWRTSHHVHVASDNPIFKGHYLHMPGAMSPQFSNNVYPTYAYQKVDESKLKSYTRYLVRGFVGNSKDLELLVERYGKDVHVEMDVPNDIRYALPTNECGSFDRCRPASYQARTPHTCTCKDTTSMHTDCQCQNKVNRTSADMYTNGSPSRVMYADEFHSHQSCGCKNNDRYQNGTHPQKSCGCKDPHVFSYHIDTGCVDQEENLGLFFALKIASENGVANIDNLEIIEAQPLTGEALARVKKREQKWKQEMARKRLQTEKAVQAAQGAIQNLFTNAQHNRLKFETLFPQIVHAEKLVEQIPYVHHPFLSGALPTVPGMNFEIIQQLLAVIGNARALYEQRNLVRNGTFSSGTGSWKVTEGVKVQPLQNTSVLVLSEWSHEASQQVRIDPNRGYVLRVTARKEGAGKGTVTMSDCADYTETLTFTSCDFNTSGSQTMTSGTLSGFVTKTLEIFPDTDRIRIDTSETEGTFKIESVELICMEHMEDHMYDIAGNVVEEMRYLDSSRSMGGTLDAMCYTKIGEFGC

SEQ ID NO: 73 - protein, 1267 aa, Bacillus thuringiensis
MYQNYNYNYKEYEILGIGGRDYQPRYPLAQAPNAELQQMSYKDWMNRCAGVESGELFDADAVKTMLLIGTGISWAILGVAFPPLSVAVGILNVMISYLWPSQATEDQFSWKQMMSATEQLINQAINPIIKSKAIDALRDLHSSLRDYNQALCNLQTNLDSPDVERYKEVVRREFNDANDKAKSTIINLESDGFQIQFLSSYAQAANIHLLLLKDVKQYGEIWGLTALEVEQYFDNPPSKPGNPGMIQLIEIYTDYCINWYNRGLQQQAETYYWNGFNDFRRTMTIVVLDIVALWPTYNPINYPKPVKAQLTRTVYTPTFGQHIASSKVLFDELELSLVTPPQLFTFLDAVTFYRRDDELTQYAGIMQTLRYTSSLSLFQTIQGQRTDLVDNIRIYSGVLDEVWKTASVVGELDNTSSMNIQTFSFYLLSNPENPVTIGHVYSSNTTAATYGFPCVATNISCIGEPCTPCSISQPLESICNIPNKASHLLVSVTANVQNHIRLASYGWNHLSADANNLLDAEKITQIPAVKGVRMLSNVSVVKGPGSTGGDLVKMSNGDGVFSISITSSATNERVSGYAIRLRYASNADTNFQIFMATKGQPMIVSDQIIPSTSFDNSLTYQAFDYYTLSEFELKTLPEVKQDTFFDFFKRGAGDILIDKIEFIPIEGSLEEYKANQALEKARKAVNTLFTSDAKTVLKLNVTDYAVDQAANLVECVSEEFHAQEKMILLDQVKVAKRLSQTRNLLNYGDFESPDWSGENGWKTNHHVHVASDNPIFKGRYLHMPGVTNSQFSNNVYPTYAYQKVDESKLKSYTRYLVRGFVGNSKDLELLVERYGKDVHVEMDVPNDIRYSLPMNECGGFDRCKPELYQGRPLHTCTCKDTTSVHTDCQYQNKVNRTSVDVYTNGSPSRNMYADGFHSHKSCGCKNNDMYPNGTDSHKSCRCKDPHVFTYHIDTGCVDQEENLGLWFALKIASENGVANIDNLEIIEAQPLTGEALARVKKREQKWKKEVAKKRLETKRAVQAAQGAIQLLFTNAQYNRLQFETLFPQIVRAEKLVEQIPYVYHPFLSEALLAVPGMNFDIVQQLSALVDRARGLYDLRNLVQNGTFSSGTGSWHVSEGVTTHPEGNTSVLVLSEWNHEASQQLRIDPDRGYVLRVTARKEGAGKGTVTMNDCADYTETLTFTSCDYNTIGTQTMPGSTLSGFVTKTLEIFLDTDRIRIAIGETEGTFKIESVELICMEQMENHLYEMAGNLEEEMQALEGSVAKFE

SEQ ID NO: 74 - protein, 280 aa, Bacillus thuringiensis
MEVINMAILDIWAEVDKFATNYCKGRGLTYSGKKGPVPQYPLIMTNFQSSLPDDRVLTPPEHVATLPKTYDNITSRPQTTTLSFSEELTESTSTTTTEGVSIGTELSSTQTFKIKFVEVGLTQTVSSEYTTTSSKTLTTEKKRIVTSAEQITVPPYTRIKAVLVIENGIYDLITDVTCDLNGMIYFEATNGTSFLSTIYEVLKGNNTPDFTFSFEDPEDPTCHFNGSGKIKGNSGLNSYVRVEQSPLEGYSGQYRQYILPGQDLTTDIITSENFGIPIFN

SEQ ID NO: 75 - protein, 1354 aa, Bacillus thuringiensis
MGGLLMNQYEILDNGDMGYQSRYPLAQAPGSEFQQMNYKDWLNRCAVGESGELFGDSNALRDGTVTSVTILSVILSVSFPVASAAVGIIAVVLPFLWPEQAGTPGTSEAQFTWEQLMDAVEELINNAIATEAKRDAIDALENLQTSVNDYYRAVCNLKTDPDMNSYKERVRITFIAVDQKARDTINRLNDNPPTHAVQFLPSYAQAANLHLLLLRDVVQYGESWGFTAVEVQQYFSNTTGVGNPGMLQLLAIYTDYCVRWYNTGLRQQYDTGDWNKFNNFRRDMTIMVLDIVSLWQTYNPKLYAVPTKSQLTRTVYTPLLGFTDPYGTGFTPIQVIEAAVTDVPRLFTWLRELSIDKNIDPFPGRPIEPSQPGYFTGRRIVFQNTLDSTLFEGGYRGNPGELRETLTIPSPELGDDVWRITTKDTILSALEGRDIKSWSFSLTKSPDQSLYGGTYSTNSVLTGLPCNNSVSGPCNPCNPCRIESPNMNVPCNDKNLYSHRFSYMGAGTIYVIGKNYLAYFSYGWTHVSADANNLIDPEKITQIPAVKGSSIWNGATVIKGPGSTGGDLVQLPIRTSMHLEVTLPAFDEDIVASYSVRIRYASSQSTNLGVQFEGEIEQGSRLVELPATYSGGDLTYNTFGYQFALGITSHSESQRGTIILNHVGPSGPNIIIDKIEFVPQKVSVTEYEANQNVEKARKTVNALFTNDAKNTLRLHVTDYLVDQAANLVECISDEVHPKEKMCLLDQVKVAKRLSQARNLLHHGDFESPDWSRENGWKTSNHVSVTSGNPIFKGRYLHMPGAENPQFSDQVFPTYMYQKIDESKLKPYTRYMVRGFVGNSKDLEVFITRYDKEVHKSMNVPNDIPPMNPCTGEYQLGEGPMLTNYTIPQDMSCDPCEVGTVMKVQQTFVKCEDPHVFSFHIDTGELDMERNLGIWVGFKIGTTDGMATVDNLEVIEANPLTGEALSRVKKREQKWKQKWTEKRTKIETAVQTAQGAIQALFTNANQNRLKPDINLNDILQAENLVQRIPYVYNEFLQGALPPVPGETYDIFLQLSSAVASARSLYEQRNVLNNGDFSAGLSGWNATDGADVQQIGSASVLVISDWSASLSQHVCVKPEHSYLLRVTAKKEGSGEGYVTISDGTEENTETLKFTVGEEATSSPSSDIRSNLRERYQERNMVNASEEAYGTNGYASNPMANYPSDNDRANTHSRNNYRTYPSESFGITPYSDENPMTDYPTNKYEMNTYPGSTNMTNPNGGCSCGCSTNTYAGENMMMNASSNANGAGYGCGCRTYINNSTDSYASPMTARNGSSLSGYVTKTVEIFPETNRVCIEIGETSGTFKVESIELIRMDCE

SEQ ID NO: 76 - protein, 597 aa, Bacillus thuringiensis
MKPNNQNNHQTLLSNVTVDKPFADALKNETTMELKNSNHEDCLKMSEHESIEPFVSASTIQTGIGIAGKILGSLGVPFAGQVASLYSFILGELWPKGKSQWEIFMEHVEELVAQKISTYARNKALADLKGLGDALAVYHESLESWIENRNNTRARSVVKNQYIALELMFVQNLPSFAVSGEEVPLLPIYAQAANLHLLLLRDASTFGKEWGLSTSEISTFYNRQSNRTIEYSDYCSKWYNTGLNRLRGTNAESWVRYNQFRRDMTLMVLDLVALFPSYDTHMYPIKTSAQLTREVYTDPNGVVAGPNNSWFKNGASFSAIENAIIRKPHLYDFITNLTIYTRISRANPSYMNLWAGHRITFNRIGSSNSSELVYGAITNPVSTSSLSFVNEDIYRTTSLAGALGTLSGLIYGLTKADFDTRFRNHTNIASGKTYFPGHSGIGTQVRNSETELPPETTEQPSYRAFSHLLSHISMSPTTAATPPVYSWTHQSADRTNTINSDSITQIPLVKANNLHPGAIVVKGPGFTGGDILRRTSTGTFVDLPVNLINWQLSQRYRVRIRYASTTDLQFHTSINGRAINQGNFSATMNRGDALEPV

SEQ ID NO: 77 - protein, 1092 aa, Bacillus thuringiensis
MNLNENESIIKKHGRINNQTEHGLEKVRKAVDSLFTDEERNSLKLTVTDYNVDQIANLVECISNEILPREKTILLDRIRLAKRLSYARNLLSNGNFESPNGPRLKGWRTSSYVKVLTDNPIFKGRYLHMPGARKFESGNVYPSYVYQKVDESKLKPYTRYLVRGFVGSSKNLKLLVQRYGSEIQVEMDVPNDIRYDMLTSTFGGWEGERQQSYQIIPTHTCTCKDKISINTMGQQMNKSCGCKNPHVFSYHIDTGSLDFTENLGLWFVLKIMSTDGEANINNLEIIEVEPLTGTALAYVKKREHRWNVNMTQKRLQADEAIQVAQEAVRNLFTNPQENQLNLDSTFLNLVIAADLVDRIPYVYDSFLIGALPSMNFEIVQKLSQLIDRAWRLYARRNFVRNGTFKSYTNDWHVTEGVEVKKTYNTSVLVLSNWSHEASQQLQVAPNRGYLLRVTARKEDAGRGTVTISDSAEIIEMLTFTSCDDETVSEEGAFWGFVTQTQEFFPDTSQVQIDIGETEGMFEVASVELICMEQMDTPLYNIACQKDIDIPSNSVGCAQKQAINFHGPLLDRLSTDGRTYWEYLTRYSPVMYQAINKSYSNGKTDLITKFNADGNWNMADQWESIGEFPQIPYVYASVQETKTHLFLGYYFYHARDEGFFPAEGHENDLEGMMIAVRKDGNYGVPVAMETIYHSDFLRYRLKDPNVQPGYSKIENTSVRFSEVTHPEVFISANGDLLGEFGHSVSAFTGNESVENNGIVYKFGEPPSEEPTQFSPEWQHTYNYGILPIDELWEKKYSYDNTPFQSFGVFPNTAPGGTGNANAPWNWSDEDQDGTLGKGIFFTDPAYLFDIDFNGLGTFSHEYVYNPYWTHKVILKSVTPKVYKDPSNNLPDIYISMEQYPLKGMRYISERVWMKSDAALLVPHTVKFGGDQKTANTTFSEPTNTLYIAVSNINPLLWLEVKDYDASDADDYMGSIVLPLDTGNIAGKADLKEAIIDYEVITNQNFPLAPEGVYIYKDVNFSGPYTLLKHSVANFKDIGMNDTVSSIKIVGPYDVIGYSDANFTGRFAPLVTTDNIDSTNIKNDEMSSIRITRK

SEQ ID NO: 78 - protein, 1787 aa, Bacillus thuringiensis
MADSQFFLPAYYNVLADPPFISNTNVIESNLDAAAGPDCSDPNNALNMLCFAQDISTAWNKGKESGSYDLLEKTIGNSASWAFGGSSPSPGNYLDMAKISIGLTGHIIFLGLTTTAGLAPGWIVAGHVTKRILVPISKLLATTFWPKKNDPNSASDNTWHLVSDRVETLVQQDITAYDSSSLTQFIAGFQAVLDDLHEAVAVAICQGQSPDNQTALNCKPYADEVLNENVRVKFATAEETFRSLLPQFQKSGYEFTELPQFCQAATLHLSLLHSAINMADNWGIPPALKNNYAAQLRTLIQTYTQYVYSTFENQRQKVKASSWDNTNQTWNGVPKSGINRYLQFLQVAILECLDYVATWRFYDVYDYPLPAQSDFSRIVFGTIVGPSENVHKNPSDKYKGYDDDPVVKFVDFDLNTGANKSPLTWPDFENKTYMPIDLDPGSTSFHLTAHDLNHIYVDGIEVGYNYTDVIARTSKKVTPKYALRDTVSPNTGNFPQDQWAQIKATSLIDTSYKYYPLNFINIGSRQTDQMDYSEVSWSINDNSNDDHSTDLVFINAPFTNNNCSYPKPKDLGSGYDDGQPCQSNTHTLGTDVIRVLYPVVAQGGKSTNKIGFLPLYMHTNLEPTNIIGQLDPDAPEDSDSSSEIRMLQTRTIPVEKGVLSGAATNVVERVTGSNSVLLKNKGSVKVPITVQTGGKYFIRVHAATTAKDGKLSFHFDSPSYKPPEDFTITLENTKQYLDDTTCNPNNSCYNTVSRDCSTCDENTGKNTGSTCYHTDTKTCSAPSHPMWIQGVENRVYALFPKMGIDTNNPGNPAIPQSTIVELMPVNYNITITNTSDVDIIIDRIEFMTIPKMEQVSTPPSGNETEKQIAEIPTSQDFYAVSGSPTLIWETYDKTVLTRAELNLENPPSDILNSYQFQFYYDTFPQSATKTTTNGIDSYSVPSGFNKIIFTSTVSQTEPFKLSGKIYEPIPPIDPPGAPPTEKQIGSIPNGTPFIGGDNLTTTIWSSLDGTLANHAELTIENYPSGFLNSSQIQFLYNGLPQQVNKKINGNQGSYVVPKGFNQILLTSTNSGMVTFNLSGKVYAPLSPLDPPVQIETERQIDTIASGTPFMVGADHSTTIWNMDGAAAYRAELQLEHYPSDFLKSATITFSFNNISQPAIKTTTNGIDSYSVPQGFDRITLLSTNSQWETITLSGKIYEPIPPIKIIGTISKSHYMQNLDSIIIWSSDTVGQKATISNDATIQALYEFFLNDQKVSSYHSTPGKYMVPGVDYIDVGTDFNKISFSLNAPGNAQNVDISGTVFGPSKDSEPSSVFTKQEDLDKIKQLVNSLFHDVTHTTLSPVVTEYWIHQVRKKILALSDQKFGLQKKELRKLLVLAQRLSANRNLLSNGNFNSSTDWLLGRHVKIFSDNTLFTGNYAFLPSPVQNSSYVFQKIDESKLKPNTRYIIRGFVANSEYLEVVAARYGIEVQQMLNVPYGTALPISSDSQSNCCKHMNTPCTPNIPDNEQAHIFNFSIDVGSLHPSINLGIEFGLRIVNPTGSARVSHLEIVEERPLTAKEICTVQQREKKWKELFTKEHAKISALIQSVLQQLLPLYKDQNWNNSILDHVTYQDFFNISLPEIPKLKHWFMEDREGEYFQITTQIRQAIYRIFTQLEEKNLLHNGSFSKGLTDWIVEGEPRMISLGKHMSALQLSNFEESVSQTITINEFQEDQEYRLRIYGKGKGTIVIQNGDQVETMAFASNDFKIQMKYLYFDTSTVTIDIQSDEKKFLVASVELFEVPSSSSPSCN

SEQ ID NO: 79 - protein, 397 aa, Bacillus thuringiensis
MLTKEMYYMYSIKRYKKVAIVAPIVCLLGTGLTFVTKPTPAAAAVTTNYATANSMSDFQPISKYTLAGDLYERYQRMIIEHPDLVTSSGVKPLTKQSDIKYQEEAFAGLAQEIRDHKLDRTLEDNPEWLKLFGMDPFFNWVPEYTNLSNQNEIKLDNPRVDNYKEDNIELATYTNTTSSEQTFLTPSKTEKVTDSFTYSNSEGGKLGASATTTIRAGIPIAQAQETLTMSFEATYNHTSSNTSSTEKTVTYPSQSLKCLPGYKTSLIVKLSQANFSGTMSFEVEPTVDQLMDAIEKNWKYKNEKYKEKGDYTIPNRKEFLYNLYKYSNLPIPSYVKLDDKEKTVSFGKITSKYTGVAGHLSEASATEVKLEPLNKAKKPIIMPLKQYQQKIENHDSF

SEQ ID NO: 80 - protein, 384 aa, Bacillus thuringiensis
MTKNAHSIKLLIQNRSIYGGFIMKKKLIAATAVLTLAVTGLEAVIPVNALASDHVKNYVLQEHIESKVFDLESLLLKHTKNDIFLSALSTSTGTVLNLDTLKADVVFGEQEVIADSLKKKTNFKTANVFINEDPEPQAFPTREISENVSDTHSKMITQGFKAGASVKAGFDLGFTKGDVTLNTEYNKSDQEGNTTVKSKTIKYPSQTITAPAKSVVVLEYSLEENKAKAYTDVNAVLAGDYEKKYFFIPAHKFIPDPLGIGILTDLIETGDIKPEKEKTQRFNLYDELANNDLLKDDDPVTLDEKNKKVILNGKILTDSSVYSDRFIIKKKTYSLEEYEQLQKNGKSGRSKRDVSSLDASKKDFSALTPIDEETYTVEGIVTEK

SEQ ID NO: 81 - protein, 1289 aa, Bacillus thuringiensis
MVILNDIYKGPYNVLASPPLLETNSIDFSDLIPKIIKTVKDTAETGKVSEILNLKKFIDEGYGNDTNVMAAIFQTISTLIPLAYPPAAAVLPIIGAFVKLIFPTNSKSTFDVLKNLIDEKIDKSITSLVSQTLINTIKNFQNNVEIVENAMRTAIGTGDKINTLTKNLNEQSCSTMFDGQTCPCTPSDKCLDKVRTDFETAIAIIQLNAFENPFGESVSKPEDGYLYALPLFAKSVTLKLSLRHSYITFMKKYRFVSEEVYTKADIPKVLIDQQKEIKEFTRRILTTFNNQFFNKINPNYNSPDKLEKYINYMRIMQLECLDLVALWPFFNPLLYPNGANYQFTRLIFQNLAIPMIRYTNKPTAGHYNLRGVSGSIPNNDIFRYTYSGMRLTSAAFMTYKNGEKYNVDGEYLTFSTNYSNKDYYINSSKNDHDTVGENIFSYGIPISLRLNSSITNAKQLAPDDDQTSLFAKFLNSENWVYFAGKPELTGGSYGYNNPPVPNHKIQGVYPLVDTNQVGYAYKRGYLQTLISNDITPENILQYIEEGKTFTFPLDKVEQVNNKLRIENPYDSTQVEFANGANALKLSGGQTTIFPIKTMFPNNTTVSCQVRIRAATNAPGSLDLDIDNNQTIKLPLDNTSTITSDQVGSYGTNGTDDSLPLYVVFPRPQVNQKDGELMPPTEAIINLLAGKQYNIKITNSGSSDIILDRIEFVLFKTQQKPNEISLLPQTFPCPNEQPTLWGTSGGQQQATGMRITPDGRVDSSPIVLYLKGKFVWSLDPRTEHLEVQNILFDQVKMGSTCGSGASPSLFNGGIITLASQSFDKLEDLEKITNQVNALFTSSSQTELAQTVTDYRIDQMVLKVDALSDDIFGVEKKALRKLVNQAKQLSKARNVLVGGNFEKGHEWILGREATTVADHDLFKGDHLLLPPPTMYPSYAYQKIDESKLKSNTRYTVSGFVAQSEHLEVVVSRYGKEVHDMLDVPYEEALPITSDERPNCCKPSGCQCPSCNGDAPDSHFFSYSIDVGSLQTDVNLGIEFGLRIAKSNGFAKISNLEIKEDRPLTNQEIKKVQRKEQKWKKAFDKEQTEVTATLQPTLNQINALYQNEDWNGSIHPHVTYQHLSNVVLPTLPKQTHWFMEDRQGEHYSVTKQFQQALDQAFQQVEEQNLIYNGNFANGLTDWTVTGDAHITIQDDDLVLELAHWDASVSQTIEITDFEEEKEYKLRVRGKGKGTVTVQHGEKELKTMTFNTNSFTTQEQTFYFEGNTVDVHIQSENNTFLIDSVELIEVVEE

SEQ ID NO: 82 - protein, 1452 aa, Bacillus thuringiensis
MNQIYVSNVAEIEGIKRAKEKYPDREIPVYQHTVTSQNLCATINPPTLVMNTDMRGTNTFENKDSFQKTQSSDLRNINLSEWRDLGGNVNSPQFTKQRLIDNGQTSLDIDLEIGVTSAAGIAWALLGISHPIGSAVAGVVNVILPILWPTTTEDPDEVWKSMMGNAEALVDKKIDEAMKNLAISKLNGLKNSMNEYCQALARLKADPNNPIEQASVRSAYQSMDMLFLYSMPQFAVPQFEVQLLPTYAEAANLHLLFIRDAVKFGNEWGMTQAQIDTEYNDLKRLTEEYTNHCVNWFNTGLQRMDPFKNPSKKPADMWNCTTYPWVAFDQYVSWFGTTQNPPKNCKSTLQTSICDNQGIENDSEVTPQLGSYRGSKSEYQGLENWNLYNNFRRDMTIMVLDVVSSWPTYDPIKYSIGGIQSELTRALYTPIRGTTYRSDSAQNTISAIENRMIQKPHLFTWLNRIEFNELWVGDNLYTKGYVLIGGKIIRKFTSESTVEESFGKSDPSARKMNVDITPNDPIKKIITRQWFEPREIELYKGATYLFTLGTIQEPMPNFTGIITSGCYPTGGVPKPCIYDPTRKENMMPKAVDPNTPNAPRSQWKDSHRLSYFKYEPIRSNSPYGYPSQGQIGAVALEWTHMSVNPNNTIALDKITQIPAVKGWELRGGAKVIKGPGSTGGDLVQLSGDFNDLTVQVTIPSSEVIGGYLIRLRYASNLNTKIFITFQGLEILSNVFDLPATYSGGDLTYGTFKYKDTLLIPSPDFEIITTIDLSNDNKSSNIIIDKIEFIPIKGPLEDYEANQKLEKARKVVNTLFSDTAKQRLKENIMGVDLDIAMGLIEEIPDDRFQKEKMILRDRIKQAKRMSQSRNLLQYGDFASPDWSRENGWKVSRDISVESTNPILNGKYLNLPSARDPLSDGNVYPSYAYQKVEESKLKPYTRYWIRGLIGSSKDLELVVSRYRKEVHKILNVSDNLNVTSLRSHLESLSDSDMLGQVRETLQNVSCGPYLPLLQTNNPGEDPHIFSCHIDVGELDPSCNPGIEVALKINAVDGGAQIRYIELIEGAPLTSEEMARVKRQEKKWKQKRNQIFIRNQAAIQAARDAVHRLFVSPTCGRLKLTTTLQNIEYAQTLVNAIPDRYNPILSELPGVNMDIFGHLQNQLEMAYGLYNTRNVVVDGDFMSGLANWNATEGAAMQQIDGTSVVVISDWGANVSQEICVNPEHGYLLRVTARKEGLGKGYVTISDCTENNTETVTFVSDEDRMAYTESLRDMSIETASMGDAPYEGDSNTLNVPPDRYGRNTSYAGNTNMNYSSESFGFTPYGDQNQMMNYPSSNDEMSVYANNPNMTNGHGTGCGCGCSTNAYSGEYKKMNTPPNNYEMNAYSTNENTLTNDEAKYEAASYSSPIPEQNGSFLSGYVTKTVEIFPETNRVRIEMGETEGTFMIESVELIRMEC

SEQ ID NO: 83 - protein, 1357 aa, Bacillus thuringiensis
MGVLLMNQNYNNNEYEILDNGGISNQPRYPLAQAPGSEWQNMNYTDWVNRCNCGEPGELFNDTTTAVRNGLIIGTGVGWALLGLIPVIGGPASAIAGLFNVLIPYWWPEQAGNPGTAQAQFTWEQLMSAVETITDKKILNFKKSDAIARWQGIQLLTRDYYLKLCDWINDQTSPSKQAAVKDAFDDVEDYIKISMPFFEAQGFQVQMLSMYAQAASMHLLLLRDVVKYGVGWGYEPYEVERYYSHIGLGNKGLLQLIADYTDHCVVWYNTGLQEQYNTGDWNKFNDFRRDMTIMVLDIVSIWPTFDPRLYTVPTKSQLTRTVYTRVSGDTGGGNITVEPTLPIDVVESNVVDIPRLFSWLRELTIDADNFPSSSPGRFDMKGRGLKRQNTLSNTIEVGGYKGEAGNRQQTLSIPSPQSNDDVWKIDTLIRIAFNDGSRAVNGWDFKFTQSPNQHLYGTPFFPQEVAGFPCKGQNLRPCEPCVSCSSELPDMNVPCNDKSLYSHRYSYMGLGMLTYNSTTPFRYAAYFSNGWTHVSADANNLIDLEKITQIPAVKGYSLTGTSRVIKGPGSTGGDLVKLSASGMLGLAITEPSGTHAYRVRIRYACNMDINILVLNEVTAELGRFIAPATTTDMTNLTYDKFGYLDTLVYSYSSLEDVNNGLNIYNLGSDEATIILDKIEFIPIQGSVETYEADQALEKARKAVNDLFPNDAKNTLRLHVTDYLVDQAANLVECISDEVHPKEKMCLLDQVKVAKRLSQARNLLHHGDFESPDWSGENGWKTSNHVSVTSGNPIFKGRYLHMPGAENPQFSDQVFPTYMYQKIDESKLKPYTRYLVRGFVGNSKDLALLVARYDKEVHKNMNVPNDIPPMNPCTGEYHLGEGPMLTNYTIPQDMSCDPCEAGTVMKVQQTFVKCEDPHVFSFHIDTGELDMERNLGIWVGFKIGTTDGMATVDNLEVIEANPLTGEALSRVKKREQKWKQKWTEKRMKIETAVQTAQGAIQALFTNANQNPLKPDITLNDILQAENLVQRIPYVYNEFLQGALPPVPGETYDIFLQLSSAVASARSLYEQRNVLRNGDFMAGLSNWKGAKDAIVQKIGNASVLVISDWSATLSQDVCVNPEQGYILRVTAKKEDSGEGYVTISDGTNDNTETLKFTADEEMTSMAQSDIRSPIRERYQERNMVNASEEAYGTNGYASNPMANYPSDNDRANTHSRNNYRTYPSESFGITPYSDENPMTDYPTNKYEMNTYPGSTNMTNPNGGCSCGCSTNTYAGENMMMNASSNANGSGYGCGCRTYINNSTDSYASPMTARNGSSLSGYVTKTVEIFPETNRVCIEIGETSGTFKVESIELIRMDCE

SEQ ID NO: 84 - protein, 807 aa, Bacillus thuringiensis
MGGLLMNQNYNHNNYEILDNGNRDYQPRYPLAQAPCSELQNMNYQDVMNTSIGREYQAVQQVNVGEAVSAALGILTTILKAANPTLGAAAGVISSIFGFLWKRFGTDPQAQWKQFMDAVEYLVNQKITDAVRSKAVSELEGVQRALELYQEAADDWNMSPNDADAKERIRRQFTSTNTVIEYAMPSFRVDGFEVPLLTTFAQAANLHLLLLRDAVKFGAGWGLPSAEVEDNYTRLQARTAEYTNHCTNTYDKGLKQAYDLAPNPTDYNKYPYLNPHSKDPIYGKYYTAPVDWNLFNDFRRDMTLMVLDIVAVWPTYNPRLYNNPYGVQIQLSREVYSTVYGRGGSTNSTVDAIESTLVRPPHLVTELTKLTFDERNLYEAETVPVAFKKVTNTLRNVGSSTTWEQSFSSTGGSLKTVHNVWATDIGNLSLNLGAVPLGFSFYNENDQHLTTVGYSGGLWNGIPKGEGSNQNSHHLSYVAALETQSTAGWWPYTYPVNLLGEWGFGWLHNSLTLDNRIATDKITQIPAVKAFKLTPYNNNTKVIKGPGSTGGDLIQLASGFLQYSFPSTDNRQYRIRIRYASADGSALRLRQWIGNGVSDSTHNLPKTYSSGPLTYNTFAIFDTGRIMQTTSSFELWLDNIGSGTLIIDKIEFIPINPIESPPEPKPPVLPGTYQIISALNNSSVVDMDPTSKNVQLYGNGNANNQKWELVFDPSQGAYQVENLANTSLVLTWQVMQGLNVNAAPNLGNPEQYWIIEDAGNGYVYLRNKKDRNKVLDVDHSGTANGTNIQVWDYNGSNAQKFKLNRLS

SEQ ID NO: 85 - protein, 679 aa, Bacillus thuringiensis
MNQDVTRAREAVYALFLNNTLQLKVTDYQIDQAAKLVECISDGIYPKEKMCLLDKVKAAKRLSQARNLLNYGDFESLDWSGDNGWKTSYHVYVTSDNSIFKGRYLNIPSANNPQFSDKIFPSYAYQKIDESKLKAYTRYMVRGFVGTSKDLELLVARYDKEVHKKMNVPNDILPTDTCTGGYLLEQGSYPVLTNQMMPQNMSCDPCDTGYRNEVGTMVPNTSMMCQDPHTFKFHIDIGELDMDRNLGIWIGFKIGTTDGMATVDNLEVVEVGPLTGEALVRMQKREPKWKQKWAEKRMKIEKAVQAARNAIQALFTSPDQNRLQSAITLHNILHAEKLVQKIPYVYNQFLLGALPSVPGEQYDIFQKLSDTIALAQSLYGQRNVLNNGDFSAGLSGWNATDGADVQQIGNTSVLVISDWSASLSQHVCVKPEHSYLLRVTAKKEGSGEGYVTISDGTEENTETLKFTVGEEATSSPSSDIRSNLRERYNEQNVPNASEEAYGINGYASNNMTNYPSVNYGVNAYPGVNNNMTNYQSESFGITPYGDENSMMNYPSNNYEMNVYPSSTNMTNHNGGCSCGCGTNTYAGESMTMNNYPSSMYETNAYPSSTNMTNNQGMGCGCYYSTNEHPMVEQNTLDLSGYVTKTVEIFPETNPVCIEIGETSGTFMVESIELIRMNCE

SEQ ID NO: 86 - protein, 1460 aa, Bacillus thuringiensis
MNLNDNKNEFEIMDHGSMGYQPKYPLAKESVPTGQNMNYTDWMNRCANGEVDVFGDTSGSVRNALIYGTGVGWALLGFIPVIGGPASAIAGLFNVLLPYWWPEQAGASGSPQAQYTWAQLMAGSEEITDKKILESKKSDAIARWQGIQSMGRVYYEKLCDWIGDQNNEVKKDRLRDAFDDLDDRIRVSMPHFQAQTFEVQMLSMYAQAANMHLLLLRDVVTNGTNWGFEQFEVDRYYSNADGLGNPGLLQLLNSYTNYCIDWYNTGLQEQYDTGDWNKFNNFRTTMTISVLDTVATWPTFDPKFYSLPTKSQLTRIVYTPRVGDTARSNRPSASIDAQENNIVSSPRLFAWLRMVDVSLQKNGLSNEIASYKQTFHNTLHTNLWSITKGTPTNDVRNMFTTPYFPYDDIWKIKNEFFDYDSPFDDLAVDNWTFSFRYSDDQYFELSTYDKSVTRFYGLPCRAKNSGICDPCDSQNPCRKELPNTTMPCEDKRLYSHRLAYMGAGENVYPPPSLTYSAYGWTHVSADADNRIDAEKITQIPAVKGSWLNEGTVIKGPGSTGGDLIQLHSYGTSIALSVTIPAGIQTYRVRIRYASNADLPILVSLGYSGLDTFIAPATTSDLTKLTYNKFAYLDTLVFTSREDPNGLYEQLIFIRHNGLESRTFIIDKIEFIPIKGSVAEYEASQAVEKARKAVNTLFTSDAKNALKLNVTDYAVDQAANLVECVSEDFHAQEKMIMLDQVKFAKRLSHARNLLHYGDFESSDWSGENGWRTSQHVHVASDNPIFKGRYLHMPGAMSPQFSNNIYPTYAYQKVDESKLKSYTRYLVRGFVGNSKDLELLVERYGKDVHVEMDVPNDMQYTLPMNECGGFDRCQPVSYQERPLPTCKCKDTAVAHTDCKCKDKESRTSTNRYTFEPTGNAVYMNGSDHKSCGCKNHDMYQNGTHPHKSCGCKDPHVFSFHIDTGCVDVEENAGLLFALKIASTDGVANIDNLEIIEGQPLTGEALARVKKREHKWKEEMKQKRCKTKEAVEAALTAINALFTNKQYTRLKFETLFPHILHADELVQRIPYVYHPFLQDAYPDVPGMNYAIFQQLSALVVQARGLYDMRNLVRNGTFSAGIGNWQVTDGVATQPEGNTSVLILREWSDKALQHLRIHEERGYVLRVTARKEGNGDGYIVIHDCDHQQEKLTFTACDYSTMRASTGTQTMMTPPTNCMPCKSTTWKDEMTTSVPMLSGYVTKTAEIFSDTDRIRIEIGETEGMFKIESVELICMEHMEDHMYDMARVGPAKAEEHPILKDANGSPVVYGQEYYMEPYEFPGYKLGESMNAGGINEIALAPSMYMKQMELTFEKNVTTPEDMVFIQHKATGPGSGLHGIHYVSVFDSSTSYLQLMYPSTDANQSMWKPILPSVDMDSKFIDGNYFAFKNENLNVFLAYQNLNERRSYAHVGTMNSKTMWRLIPIQ

SEQ ID NO: 87 - protein, 1225 aa, Bacillus thuringiensis
MSPNNQNEYEIIDATPSTSVSNDSNRYPFANEPTNALQNMNYKEYLSMSEGYDREYFASPGALVSGKQAIKVGIDIVGKILGALGIPFVGEIVGFYNFILDQLWPSNSVSIWEQIMTLVEELVDQKITEYARNKAIAELTGLGNAMDVYQQSLEDWVANPNDARTRSVVATQFTALELDFVQAIPSFAISGQEVPLLGVYAQAVNLHLLLLRDASIFGEEWGFSSSEISRYYNRQVQLTSQYSDYCVKWYNTGLQKLKGTSAENWLEYHQFRREMTFMVLDLVALFPNYNTHMYPLETKAQLTREVYTDPIAFNLSGAAGFCSPWSKYTGISFSEIENAVIRPPHLFNVLRSLEINTVRGTILGNTKDFQNYWSGHSLRYNFIGNTTISESNYGYLTSEKTRIELDTRDIFEINSTAANLANYYQQVYGVPQSGFHMVRWDSPYNTSTQLYSKTYTTPKDCTQVYQSSEEIPVERTVPVNEGYSHRLSYVTSFDFSKIINSFVRNGNLPVFVWTHRSADLTNTIYPDVITQIPVVKAYALGSSILPGSPSPTIVPGPGFTGGDIIQLLANTKGIAYMNFEIQDINKEYIMRIRYASAANPEFNIAVGTSGERVSTSAQKTMNPGDILTFNKFNYATFPPIKFNSTKISIALTASLAAFASTLLETYIDRIEFIPVDETYEAEADLEAAKKAVNALFTNTKDGLRPGVTDYEVNQAANLVECLSDDLYPNEKRLLFDAVREAKRLSEARNLLQDPDFQEINGENGWTASTGVEIIEGDAVFKGRYLRLPGAREIDTETYPTYVYQKIEEGVLKPYTRYRLRGFVGSSQGLEIFTIRHQTNRIVKNVPDDLLPDVPPVNSDGRINRCSEQKYVNSRLEGERGLPNGNRSAEAHEFSLPIDIGELDYNENAGIWVGFKITDPEGYATLGNLELVEEGPLSGDALERLQREEQQWKLQMTKRREETDRKYMAAKQAVDRLYADYQDQQLNPNVEITDITAAQDLIQSIPYVYNEIFPEIQGMNYAKFTELSNRLQRAWGLYDQRNAIPNGDFRNGLSNWNTTPGVEVQQINDTSVLVIPNWDEQVSQQFTVQPNQRYVLRVTARKEGVGNGYVSIRDGGNQTETLTFSASDYDTNNVYNTQASNTNGYNTNNAYNTQVSNTNGYNTNNAYNTNGYNTQASNTNGLYNEQTGYITKTVTFIPYTEQVWIEMSETEGTFYIESVELIVDVE

SEQ ID NO: 88 - protein, 1089 aa, Bacillus thuringiensis
MQPSSQNNPVPYSTSPAYTQTNLQFISDLDPTLNFFKKLKIGLINGQYVEVIMEIWESVKMHKINYLSFVDLSISLITISVPHVGITVPFLNLFFSEFTGNYSALPIPDIFTAIIYDTQNMFNQNLTTDQENLNTMIKEFKQNMENYKKELVTLEENSEVFFDTFDHTDKLLTDTINQFIVSDYTQLHTPYFAIFATIHLMIHRDVIIHGGKWGFSDIFIHKKRNNIKKLIQKYLFIGSNLFKKELDNLLASQSELEVHTLPSHIQKFPLYIPNIYRLWPSLDPNIYPNYTELGKTELLLVHPTVIIESNLFTNNIHTNDNELTSMNANISSYLNSILPEVNNKHLHMYAPREIPSENIIGTIDVCPDILPIKITSLSIVNYDDNQGETVTEWINGGSIVKLQFKQVVTVSFINLYNHAYQIRLRYATEYNKEAIIWVCIRDNQTGKTLLNSKLSFSAPTDSNSIQGEYGKYIVNIIMNGEHDTKKTTVYAGSYTIFIKNLMEENLFLDRLEFCKKPIKNNTLIVLPTRELNSPPAGGIGWTNLWIAECNRIGTAFEAVTAVAEGEYRFYYKGNLVGVIQGTTFYENFDTVQIYFHNCVVNTINLFTGANIWTEDDSQECFKNNEDLKKIRKQVNSLFIENLHKNLKPDITDYWIDHVALKVDSLSDEIFGKEKKELRKLINYAKRLSKTRNLLIGGNFEKLDNWYLGRKVVRIEGEKLFKGYHILIPPPIEYPSYVYQKIDEDKLKENTRYIISGFIAQANHLNIVVNRYGNEINHVLNVLNIDLVPTIPEALTNSCIAKIPLTFDNKRDVSSNFFSYSIHVGSLQKQENIGIELGLRITKPTGFAKVNNIEIYEERPLTNQEIRKIKYLEAKWKHSFTQSESNVIAQLEPVLQQINALYQNSDWNKSIRSTVMFQDVRAIKLPHLPKQKHWFMEDRTDVHHTIIQQMQTSIQYAFSQLNDRNILQNGNFTDGLIGWIPDGNVQIILSEELNKVISLSHWDASITQLLDIPDFNPNQEYQIRIYGKGNGTIMIQHGNKIEVIHFSSKVFMSKPSRYMTFETAAIELYIVSEGGEFIIDNIQLTKIPLE

SEQ ID NO: 89 - protein, 672 aa, Bacillus thuringiensis
MKNMNSYQNKNKNEYEILDTSRSSSTMSTRYPRYPLAENPQISMQNTNYKDWINMCASRNLEDGIYPTSANDVITNSINISSYILSMLGMPNLSSIIAIWGVLFNAFWPVSGNQWEHYMNHVQALIKRELQAFAREQALRQLEGLGGNLGLYKEALAEWEQDRDNPTTKERVRDRFRILDGFFTQYIPVFRIQGYEVQLLSIYAKVVNLHLLLLRDASMFGADWGMSQTNINDNYNRQMKLTSLYTNHCVDFYNQGLNEARALSNSSWDIFNDYRREMTLTVLDIVALFPAYDYRRYPITTKVELTREIYTPAIASQTWSNHNHLSPNVNFQFYENNLVRPPAFFTWLDRTEMFSRNLSIEVSEAWGGHINHFHHTGEQPLSSRSGFIGSDQRRVSYYDFNFVGNDVFRIYSRVMSNQVGNFFGVGQGDFFLVNSDNSNTKTISFTTRATNSNQRSIFSQFPGENSDPPTSKDYSHRLSWISGAFIGSDLANVLSYGWTHRSVDPNNTIYPDRITQVPAVKASSAPDCTVILGPGSTGGNLVSFGRSGRLNMQFKFTNIQTEYRVRIRYASTAVNTLFVSFSDYNRDIALNSTGALSLNNLRNENFAYFEVPGGIFRPALGNTLIISNWTTVAPRLVIDKIEFIPINATTARYGSKQELEKATKVVNNLFIN

SEQ ID NO: 90 - protein, 546 aa, Bacillus thuringiensis
MENMFTNNAKNALKIETTDYEIDQAAISIEYMSDEQYPQEKMMLWEEIKHAKKLSQSRNLLENGDFQDSYGYVGNRWTNSNSITIQSNDPIFKGHYLHMSGARDIDGTLFPTYIYQKIDEFKLKPYTRYRVRGFVGSSKDLKLVVTRYGNDIDAIMDVPNDVADMQPRPSCGDYNRWESSSQSVMNSEYPTPYTDGEASDMYSSQSNRGKKHVTCHDCHTFDFHIDTGELDTNTNVGIWVLFKISTPDGYATLGNLEVIEEGPLTGEALAHVKRKEKKWNQHMEKKRWETQQAYDRAKQAVDTLFTNVQGEELQYHITLDRIKKADQLVQSIPYVHHDCLPDVPGMNDDLYTDLNGRITRARYLYDARNVIINGDFTLGLTGWHASGHAAVQQVDGASVLALSNWSAGVSQNLHVQHHHGYVLRVIAKKEGLGKGYVTMMDCNENQETLKYTSCEEGYMTKIVEVFPKSDRVRIEIGETEGTFYIQSIELLCMKGHTSNYNQNTSTMYEQGYSSNYNQNTSDVYNQNYTNNYDQHSNCTCNQGYNR

SEQ ID NO: 91 - protein, 1247 aa, Bacillus thuringiensis
MNQNYNNNEYEMMGTGGMDYQPRYPLTNAPGSEFQQMDYKDWMDMCTNESVGDVFGDTANAVRDGLIIGTGVAWALLGLIPVVGGAASAIAGLFNVLLPYWWPEQAGAPGTPQAQFSWNQLMTAAEEMVDKKILESKRGEATARWQGIQLLGRDYYSALCDWIHDQDNAGKKERLRDAFDDLDDQLKLAMPFFSVQGFELPMLSMYAQAANMHLLLLRDVVQNGVSWGFAPYEVDRYYFDPSGQRSPGLLQLLGTYTNYCVEWYEKGLQEQYNTGRWDKFNNFRRNMTIMVLDTVAIWPTFDPRRYPLPTKSQLTRTLYTNPVGERLYRENMDSLENTLVAPPQLFTWLREIEIPVGIVYLDDRAPLLCKQTLQRTLSSTTWSITQGEITTPVIDTLTLTIEPPHYQDDVWKVNTHGIRGNTDTVTGWTFNFIKSPDQTLMVWNNIAPGSVTDRWSGFPCRGNDSVICDPCDFENTCRKETPNTSVPCDDKQHYSHRLSYVGAQGASRHGFTPFELMWFGYGWTHVSADNNVLDEKKITQIPAVKGYHTNGAVIKGPGSTGGNLVKLSENDDLNINVAVLPPSGSALVYGYNIRIRYASSAETRLLVEQVSEDHGSYIYNIPSTSSADSLTYQSFSYYDLPFHRIGPGIEETPTSSRLLFQNSGGGDIIIDKIEFIPINTPGAEYEANQAVEKARKAVNALFTNDAKNALQLNVTDYAVDQAANLVECVSEEFHAQEKMILLDQVKFAKRLSQTRNLLNYGDFESSDWSGENGWRTSPHVQVASDNPIFKGRYLHMPGARSPQFSNNTYPTYAYQKVDESKLKSYTRYLVRGFVGNSKDLELLVERYGKDVHVEMDVPNDIRYTLPMNECGGLDRCKPASYQARPPHTCTCKDTAVAHTDCQCKDKGNRTSTNMYTNVATGSEVYTNGFHAHKSCGCGDKHMDKNGTHPYKSCGCKDPHVFTYHIDTGCVDQEENLGLFFALKIASENGMANIDNLEIIEAQPLTGEALARVKKREQKWRQEMAQKRLETEKAVQTAKGAIQNLFTNAQQNRLKFETLFPQIVHAEKLVEQIPYVHHPFLSGALPAVPGMNFDIFQQLLAVIGNARALYEQRNLVSNGTFGAGIANWNATDGVTVQPEGPTSVLVLSNWRDKAFQNLRLDPDRGYVLRVTARKEGAGKGTVTISDYAASPETLTFTSCDENTSGTFVTKTLEIFPDTDSIRIDIGETEGTFRVESVELICMKQMEDN

SEQ ID NO: 92 - protein, 1407 aa, Bacillus thuringiensis
MTVRLSAHKLKQCILIYGEQIRAITSIPFGRHQVLTYEIMNFSEWQDLCGNVSPQNRIDIDPETAVTAAAGIGWALLGISNPIASAVAGVANVLIPILWPTAAEDPNVIWNSLMAKAEALVDAKIDQAMKALAISKINGLKNAMNEYCRALARLKADPNNPTEKAVVRGAYQSMDFLFLYSMPQFAVPNFEVQLLPTYAEAANLHLLFIRDAVKFGNSWDMTQAQIEGEYTDLRNHTREYTTHCVNWFNTGLTRLETKSANMTDCKRYPWATYYQYGWECALSPRTCPTIPLTSTCDEQTNEYYPEEKPETRGTGYRGSEGEYQGLENWNLYNDFRRDMTILVLDIVSVWPTYDPRLYQLGVKSELTRTLYTPIRGTTYRSDLNQNTRSAIENRMIPQPGLFTWLTQLKFERINIPYNGTTYGSQYTAGDLLTGGSQQRKYTLSSLSFENQFGQTGTLPIITVNSTPDSSITKLITRQWFEPREIELYKGNASQFTLGSIVERCPYLMGESGYTKQVIYDPTRRDNMIPKAMDPNNPSAPASQWKDSHRLSYFKYEPLRANSPFGYPDRGQIGAVLFGWTHMLVDPNNTISSDQITRIPAVKGYNRSTDASIIEGPGCTGGNVASLRSRVTPEGSIFQGVILIRVTGVTAKAYRVRIRYAASQSITLIFERYRSSTGAAEFSRQETLSPTYSGTLTCNSFGYHTINSLLPATDFTLWELQIKNRTNANTTIIIDKIEFIPINTTLEEYEANQKLEKARKVVNALLSDDAKQRLKGTILGSDLDIAMGLIEDIPSDRFQKETMILRDRIKQAKRLSQSRNLLHYGDFESPDWSGENGWTISNDVSVESTNSILQGKYLNLPSARDPLSDGTVYPTYVYQKVDESKLKPYTRYWIRGLIGSSQDLELIVSRYRKEVHKTLNVPDNQDLTSLQNRFESLSGPEILEQVRENLQGISCGPYSSLVQTTDNNGEHPHLFSCYIDVGDLDLDNNPGISVAFKINSVDGGAQIRHIELVEGATLTSEEIARLKRQEKKWKQKKEQMCARDQEAIRAAQAAVERLFVSPTCGRLKLETKLQDIVYAQTLVNAIPDRYNPILSELPGVNMDIFNQLQNQLEMAYGLYNTRNVVVDGDFMSGLANWNATEGAEMQQIDGTSVVVISDWGVNVSQELCVNPEHAYLLRVTARKEGSGKGYVTISDCTEDNTETMTFISDEEILESTQSLRDTSIETASRGETPYVGGSNTMNVPSNRYTENSYPGGNNMNNQYVENSYPSHTNMNYQSESFGINPYGDQNQMMNYPNNTNMTNAHEAGCGCGCSTNAYSGDNTMMNTPSNNDEMNAYPSENNMNHYSSEAYGTESYPSPMTVQNGSSLSGYVTKTVEIFPETNRVRIEIGETAGTFMVESIELIRIGC

SEQ ID NO: 93 - protein, 1372 aa, Bacillus thuringiensis
MNQNYENGEMEILESNGIRSGFSMGNIQNSNISNMSNMRYEEWQDMCGTKKEGELFSYATGTQAASDITWAILHIGNPAFSEAGGIHRTISPILWPTETQDPQAVWSSLIDRGEYLLQKPIDATLKSQVIAEINGFETLFNRYNDFLNILKQNPGDTGLQEAVRLAFNYINSQLLERIPKFSATNYEVQLLPVYTQITNLHLLLLRDAAKFGKSWGMSDADINTHQSSLTTQTRIYTDYCVRTYNTGLSNTPAPNLNDCTRYPWLRYDHPDITGPVPANPCTGRESSCDDEQGNENLPEVSPRAWYRSAKEEYAGTETWNLYNDFRREMTIMVLDLIALWPTYNPLTYNIPVKQELTRELYTSILGTTYQTDHSQNTISAIDNRMTRRPHLFEWLTGDLTVDVRQMNANWIRGYFQTKVKQRTKRTLGSTITVHESGKQGSDYHYFPNVTANERDFRAFDTNVWFEPRLFRMYFADKWYYPSWDVNVLETEPWSPEGPKTHAYQPTIRSSINRHRVSFWMWQSVRSNAPFTRWNEGQLSALNWAWTHDSADPNNTLAADKITRIPAVKAFQIKQGAQVIKGPGFTGGDVITMPSSSHGAKTQIEMNVKPQQTGKPYRVRVRYASQQSGEIFVGKWVEKWFEKGWYSIPATYSGELTQSSFRYLDTIQFTANESQFGIDLQAGIGGAVIIDTVEFIPLNTTLEEYEVNQKLERARKVVNTLFTDNANQRLKGKVLGSDLDIAMGLIEDIPSDRFQKERMILRDRIKQAKRLSQSRNLLRYGDFESPDWSGENGWTISNGVSVESTNSVLKGNYLNLPNARDPLSDGTIYPSYVYQKVDESKLKPYTRYWIRGLIGSSQDLELIVSRYRKEVHKTLNVLDNLDLTSLQNRFESLNGPQILEQVRENLQGMSCGPYSSLLQTTGNTGEDPHIFSCHIDVGELDLGCNPGIEVALKINTVDGGAQIRHIELIEGAPLTSEEIARVKRQEKKWKQKRTQIFTRDQGAIQTAQEAINRLFVSPTCGRLKLTTTLQDIAYAQTLVNAIPDRYNQIVSELPGVNMDIFGRLQNQLEMAYGLYNTRNVVVDGDFMSGLANWNATEGAEMQQIDGTSVVVISDWGANVSQELCVNPEHAYLLRVTARKEGSGKGYVTISDCTEDNTETMTFISDEEILESTQSLRDTSIETASTGETPYVGGSNTMNVPSNRYTGNSYPGGNNMNNQYVENSYPSQTNMNYQSESFGINPYGDQNQMMNYPNNDEMNAYPNNTNMTNAHEASCGCGCSTNAYSGDQNQMMNYPNNDEMNAYPSENNMNHYSAEAYGTESYPSPMTVQNGSSLSGYVTKTVEIFPETNRVRIEMGETAGTFMVESIELIRIDC

SEQ ID NO: 94 - protein, 970 aa, Bacillus thuringiensis
MNQNYGSNEVEILNSRNMSCQPRYPFAKAPGSEFQQMNYKDWMDMYNNESQAFMGERYNSSIRDSIITSTNIIAYLLSVSFPGAGAAVGIIGALLGLLWPTNSQTVWEAFMNAVESLINQRIQDTVREKAIAELEGLQNVLELYQEAFDDWSENPSQQNRYRVLTEFRGANRTFEAAMPSFRFGDFKVELLTVYAQAANLHLLLLSEGVKFGRDWGMSSLPGEEWSDIYSRLQRRTQEYTDYCVTTYNEGFDKAKMLVANLCDLNRYPWDRYNQEFRASDHPNCGARSLYIGDQLQHECNEQMNLYRASIRRSLDEYRGLENWNLFNAFRRDMTIMVLDIVAMWPTYDSVLYDNPYGIKSEITREVYTDIRGTTYRSDNSQNTIVAIEGRMIPQPRLFRWLNQFRFYWRRLSGDYTAGQIITGLQITVQTTLGSSETLPLAGYGGTSTTTWHPSYGITWIDTKQWFEPRWMRFWSGSYDAGWTDHGTVGTIEEKHPFWAAGPQQYVYNPSQRANEIPKHRLSWMKYEPIRSNSPFGWTEYQQLGALTLGWTYNSVDPNNTISSDKITQIPAVKGNAVDNGATVVRGPGSTGGDLVKLPAYNQQGTQLRVKVRPSTTARTRRYNVRIRYASEANANLFVGKYVDAANRWYETGNYAVNQTFSGSMTYNAFKYLDTISFLANEEEFKIELRCNSGGPIYIDKIEFIPVSPIGEGEIPEPPAPLLSYTYQIITSLNDRSVVDLNQSNNNVTLWNNNGGNNQKWKFVYNPSTREYQIKNLANENLVLTWNDSGGSNNVVAATNQQLDTQYWIAAEAGNGYVYLKNKRDQNKVLDVSDSNTTNGTNIIVYNFNSGNNQKFRLADVAGTLAAQVESLYRAQPGQSSRSSDNFSLGHLAAGSIVHVVLEGAGATAISFNISKDIRNGSDRRIWSDVRDGSTLRVPSGDDRNNLYISGPPRGYTSNGTFTVKFYAVST

SEQ ID NO: 95 - protein, 694 aa, Bacillus thuringiensis
MNSNVTKAREAVQALFSNPTTLQLKVTDYHVDQVARLVECIADQIHPKEKMCLLNQVKLAKRLSRERNLLNYGDFESSDWVGTDGWNVSTHVYTVADNPIFKGHYLNMPSANNPILSDKIFPTYAYQKVEEAKLNPYTRYMVRGFVGNSTDLEILIARYDKEVHKKMNVPNDIIPTNPCTGEPVSQPTPYPVMPSNTMPQDMWCNPCENGYPNAAGMMVQETNRVCQDPHEFKFHIDIGELDMERNLGIWIGFKVGTTEGMATLDNIEVVEVGPLTGDALTRMQKREPKWKKKWAEKQMKIETAVQTARNAIQTLFTEPNQNRLQSAITLKHIVDAEKWVQKIPYVYNQFLQGAISGIPDEAYAYDIFQQLSQAVVTARGLYNQRNVINNGDFTGGLSNWNATEGADVQQIGDESVLVISDWSASFSQQVYVEPEHSYLLRVTARKEGSGEGYVTISDGTKDNTETMKFIVDEETTGATMSPIRERYNERNMATPEAYGASGYASVQNNMNYPSENYEMDAYPGNNSMNYQSESFGFTPYGDENSRMNYPSENYGENAYAGNNNMYHSSNDYEMSAYSSQNNMSMSQESDCGCGCNKNAYPSENMMMNNYSSSTYEMNTYPSSTNMTNNQGMGCGCHYSADEYPMVEQSTSELSGYVTKTVEIFPETNRVCIEMGETAGTFMVESIELIRMDCE

SEQ ID NO: 96 - protein, 1156 aa, Bacillus thuringiensis
MNRNNQNECEIIDAPHCGCPSDDVVKYPLASDPNAALQNMNYKDYLQTYDGDYTDSLINPNLSINTRDVLQTGITIVGRILGFLGVPFAGQLVTFYTFLLNQLWPTNDNAVWEAFMEQIEGIIAQRISEQVVRNALDALTGIHDYYEEYLAALEEWLERPSGARANLAFQRFENLHQLFVSQMPSFGSGPGSERDAVALLTVYAQAANLHLLLLKDAEIYGARWGLQQGQINLYFNAQQDRTRIYTNHCVATYNRGLGDLRGTNTESWLNYHQFRREMTLMAMDLVALFPYYNLRQYPNGANPQLTRDVYTDPIVFNPSANVGLCRRWGNNPYNTFSELENAFIRPPHFFDRLNSLTISRNRFDVGSNFIEPWSGHTLRRSFLNTSAVQEDSYGQITNQRTTINLPANGTGRVESTAVDFRSALVGIYGVNRASFIPGGVFNGTTQPSTGGCRDLYDSSDELPPEESSGTFEHRLSHVTFLSFTTNQAGSIANAGRVPTYVWTHRDVDLNNTITADRITHLPLIKSNVQRSGRAVKGPGFTGGDVLRMSSSDADISIIGITAGAPLTQQYRIRLRYASNVDVTIRLVRQDTQSNIGSINLLRTMNSGEESRYESYRTVEMPGNFRMTSSSAQIRLFTQGLRVNGELFLDSLEFIPVNPTREAEEDLEAAKKAVTSLFTRTSDGLQINVTDYQVDQAANLVSCLSDEQYGHDKKMLLEAVRAAKRLSRERNLLQDPDFNTINSTEENGWKASNGVTISEGGPFFKGRALQLASARENYPTYIYQKVDASVLKPYTRYRLDGFVKSSQDLEIDLIHHHKVHLVKNVPDNLVSDTYSDGSCSGINRCDEQQQVDMQLDAEHHPMDCCEVAQTHEFSSYINTGDLNASVDQGIWVVLKVRTTDGYATLGNLELVEVGPLSGESLEREQRDNAKWNAELGRKRAETDRVYLAAKQAINHLFVDYQDQQLNPEIGLAEINEASNLVKSISGVYSDTLLQIPGINYEIYTELSDRLQQASYLYTSRNAVQNGDFNSGLDSWNATTDASVQQDGSTHFLVLSHWDAQVSQQMRVNLNCKYVLRVTAKKVGGGDGYVTIRDGAHHQETLTFNACDYDVNGTYVNDNSYITKEVVFYPETKHMWVEVSESEGSFYIDSIEFIETQE

SEQ ID NO: 97 - protein, 1160 aa, Bacillus thuringiensis
MNCGNHNEFDSIDETENNQTTTSRYVNVTNKVTKQGNSSNKILSNLSSNYPLASNPNTPFQNMNYKEYLNIIEGNTVISPTVGVASALTAGVTILNKILGTLLKKFAGKILVNIFKLLWPTAETDDVWEDFMEEVEILIDQKIEAYAKSRALTDLVSIGNAVERYQTALEDWEKQPENLKSLGLVIQRYNEAESHARNSMPLFAVGGFEVPLLATYVNAANVHLLLMRDMQLYGNQWGIPQSDIDLYQREQEKYTDEYTNYCVKWYEEGLKLLDPRENSSLQSFAYQWEFYNRYRREMTLMVLDLISVFPSYNAVLYPIGTTVKITREVYTDVMAYDEWYPEEVVSSFTDFESILIRPPHLYDLLERIDFYTNVQGDSYRWAGHKITYKRGPYETAHTKSYGDTAGTPTDIYFGYSDVVSTITKATRTVYGVVKSTFYQVNGEKREYDANSVGNYREAIYDSNNELPLGTSGNLDDDRSHKLCHAVLYKKDKSPTAYVIYSWTHASAGRINEVFGDKISQLPAVKMYDLGGSTTVVKGPKFTGGDLVKRKASSGGGVLGYYKCNVASSDAQKYRLRIRYCSDFSGIFRMQVNGVETIQADYSSTRDSTSTMSSESFKFREFTTTFELSEGTPSIMVALGSIYGEGEFYLDRIEFIPVDVNYDERVTLEKAQKSVNALFTAGRNALQTDMTDFKVDQVSILVDCVSGELYPNEKRELLSLVKYAKRLSYSRNLLLDPTLDSINSSEENGWYGSNGITIGNGDFVFKGNYLIFSGTNDTQYPTYLYQKIDESKLKEYTRYKLRGFIESSQDLEAYVIRYDAKHQTMDVSNNLLPDTSPVNACGEPNRCAGLQYLDENPRLECSSIQDGILSDSHSFSLNIDTGSIDLNENIGIWVLFKISTSEGYAKFGNLEVIEDGPVIGEALARVKRKETKWRNKLAQLRTETQAIYTRAKQALDNLFANAQDSHLKIGTTFATIVSVREIVQSIREAYMSWLSVVPGVNYPIFTELNERVQQAFQLYDVRKKKRNGRFLNGISDWIVTSDVRVQEENGNNVLVLSNWDAQVLQCLKLYQDRGYILRVTARKIGLGEGYITITDEEGHTDQLTFGSCESIDSSNSLVSTGYITKELEFFPDTEKVHIEIGETEGTFQVESVELFLMEDLC

SEQ ID NO: 98 - protein, 1255 aa, Bacillus thuringiensis
MNLNDNKNEFEIMDHGSMGYQPKYPLAKESVPTGQNMNYTDWMNRCANGEVDVFGDTSGSVRNALIYGTGVGWALLGFIPVIGGPASAIAGLFNVLLPYWWPEQAGASGSPQAQYTWAQLMAGSEEITDKKILESKKSDAIARWQGIQSMGRVYYEKLCDWIGDQNNEVKKDRLRDAFDDLDDRIRVSMPHFQAQTFEVQMLSMYAQAANMHLLLLRDVVTNGTNWGFEQFEVDRYYSNADGLGNPGLLQLLNSYTNYCIDWYNTGLQEQYDTGDWNKFNNFRTTMTISVLDTVATWPTFDPKFYSLPTKSQLTRIVYTPRVGDTARSNRPSASIDAQENNIVSSPRLFAWLRMVDVSLQKNGLSNEIASYKQTFHNTLRTGSWSITKGTPTNDVRNMFTIPYFPYDDIWKIKNEFFDYGSPFDDLAVDSWTFSFRYSEDQYFELSTYDKSVTRFYGLPCRAKNSGICDPCDSQNPCRKELPNTTMPCEDKRLYSHRLAYMGAGENVYPPPSLTYSAYGWTHVSADADNRIDAEKITQIPAVKGNELEGGTVIKGPGSTGGNLIQLDSYGNRIVLPIKLPVTTQAYRVRIRYASNAVLSIRVSLDGDVVLGTFIAPATTSDLTKLTYNTFAYLDTSVLTAERSTRLMFISHNDLRNSRTFIIDKIEFIPIEGSAAEYEASQAVEKARKAVNTLFTSDAKNTLKLNVTDYAVDQAANLVECVSEEFHAQEKMIMLDQVKFAKRLSHARNLLHYGDFESSDWSGENGWRTSPHVHVASDNPIFKGRYLHMPSATSPQFSNNIYPTYAYQKVDESKLKSYTRYLVRGFVGNSKDLELLVERYGKEVHVEMDVPNDMQYTLPMNECGGFDRCQPVSYQERPLHTCKCKDTAVAHTDCKCKDKESRTSTNRYTFEPTGNAVYMNGSDHKSCGCKNHDMYQNGTHPHKSCGCKDPHVFSFHIDTGCVDMEENLGLLFALKIASEKGVANIDNLEIIEAQPLTGEALARVKKREQKWKQEMAQKRLQTEKAVQAATGVMQTLFTNAQYNRLKFETLFPHILHAEKLVQQIPYVYHPFLSGALPTVPGMNFEIVQQFLVGIANARALYEQRNLVHNGTFSSGTGSWKVTEGVEVQPLQDTSVLVLSEWSHEASQQLHVDSDRGYVLRVTARKEGSGKGTVTMSDCADYTETLTFTSCDYNTVGIQTMTESTLSGFVTKTLEFFPETDRIRIDIGETEGTFQVESVELICMDQMEDAGNFEDEM

SEQ ID NO: 99 - protein, 1286 aa, Bacillus thuringiensis
MNQNYNNHEYEIKDAGIIDDQPRYPLAQAPSAEVQQMSYKGWMDRCTNEESEALFTDITVKDAVTIATSITAAVLGISFPLSAATASIVSVLIPYWWPAAAGTPGSTQAQITWERLMSAVEKLSNQKIQDSKRSDAISRWKGIQALGREYARALCDLKEEPDNAALKTTVRNKFESVEDQLKISMPYFSAEGFEIPMLSMYAQAANMHLLLLKDVVQNGVSWGYRQIDVDRYYSNTDPFLGNPGLLQLSATYTDYCVQWYNTGLRQQYAINSNNWNVFNAFRRNMTIMVLDIVSLWPTYDPKRYSLPTKSQLTRTVYTDLLGFSGHDAYPQIGIERAELELVQRPGLFTWLRELNFNLKSQSLINFVAGIEMDFDYTTVSEGYKEKEGSLGQTRETVVLPSKYSQDDIWKITTSLNLNQIPNANAVKGWIFSFTKSPDQLVSWGPAESDGDKVHSGLACNGPSVDSCDLCIIDSPCRSITPNNSFPCDDKGVYSHRFSYLGAGFTPDVSALSFFSYGWTHVSVDANNLINTGNITQIPAVKGSFSEGTVIRGPGSTGGDLVQLFPSQLLHLRVTIPADPLTGYRIRIRYASKVPAEIAVGFQSSLGEPDATYQVPATYTSGDLTYNTFGYQNTLSIPPHSEEELIYVIVNTVNSIDSEPVIIDKIEFIPIEESVAEFEANQGIEKARKAVNALFTDDAKNALKLNITDYAVDQAANLVNCLSEDFHAQEKMILLDQAKFAKRLSQVRNLLNYGDFESPDWSGENGWKTSPHVHVSSDNPIFKGRYLHMPGANQPQMSDTIYPTYIYQKVDESRLKSYTCYHVRGFVGNSKDLELLVERYGKEVHVEMDVPNDIRYTLPMNECGGFDRCGHSSYQAGTDSHTCTCKDTARMDAECQCKDKSKRIASGVYTNAYAGSDRMYPDGHHAHRSCGCNKKGGYQNGKHAHKSCGCKDPHVFSFHIDTGCVDMEENLGLLFALKIASTNGVANIDNLELIEGQPLTGEALARVKKREHKWKEEMKQKRCQTEEAVQATKTAIDALFTNKQYNRLKFETLFLHILHADELVQRIPYVYHPFLHDAYPDVPGMNYAIFQQLSALVVQARGLYDMRNLVRNGTFSAGIGNWQVTDGVATQPEGNTSVLILREWSDKALQHLRIHEERGYVLRVTARKEGNGDGYIVIHDCDHQQEKLTFTACDYTSMGASTSTQTMMTPPTNCMPCKSTTWKDEMTTSVPMLSGYVTKTAEIFPDTDRIRIEIGETEGIFKIESVELICMEHMEDHMYDMVGNLEE

SEQ ID NO: 100 - protein, 907 aa, Bacillus thuringiensis
MEKELLNLKNKYLKPVALGLLASNVLAFGGHTVAFAETNKAVSKEQTQKADALKKVKTPLVSFAATDGTSELSELQKIMNEVIKEDNGITDMFLQRTKEKAEQKGIEFDYLEFIKGVLNEGIMFTGEATEVPVLSFLNPIIDVFFPKNEKDVWDQIKPKVEELINEKLDERFTEETLNTLVLKLKGLTKNVETLKENINVLNGKGEHPDNAMIGEALVQTDKEKEQGDVRASVKDVVANINAMSEEFKNGKYAVASLPLYTQLANIHIGLLKDLAEHGEDWGYTEKQQDQNKADLQKAIKTYTNTVYETFNEGLNKMKEKQGMSNGWDEVNRYVRTMTLTSLDFASQWSIMDVTLYPQATHLDKTRQIYSDIYKDTIGHTDYDKKTGDQYYDKLLGIYSKKYPGELKNLTINKFGQDAWTNNHINGIDQEYEGSSYDYWDSQWDTKGIKSKQGTRGESLGSASFSADKPLTKKNFPDMVKRISNPDQIPAGHKVSQIISGFRDGIWDNQPFICNDVTAYVPEETRADTKVDGSQIVGIAADKVSTSQKFESVLEYVNGGNARKSSESGGTLQFEVNSTKKQQFKVRYRVASNTGTSVDLSLKAGAVNDTGKSYASKGNTSIPNTEALKDNPKKGVTGLQGTYILVEGPTVTLQPGANALEITNTGGKELVVDRIELAPVISKAGNPGWDKEHQHYYGKSGDGTKLAEGEMATDWQSIDNQYYYFGDDGTVKTSWQLIRNKYYYLNKDGTMQTGWYSPSEKETYYLGKKDDNTGLKEGEMATGWMNINNSEYYFGKKDDNTGLKEGQMATGKIKIGNKDYDFGKNGEMQKDQPGWKDDQKYYVDENGNRVTGLKTIDNFEYYFGTGDDGTNLQRGEKAVGWQKFKDGHYEYGVCVAMEQNHATSISGH

SEQ ID NO: 101 - protein, 775 aa, Bacillus thuringiensis
MRINPIIKCVATTTLFSQFLTYSSVSYAEEKQSQTKIKQVMQSEKASQVSNESSQGLLGYYFQDSNFQQLTMMAHRQVSDLQITKKEVKNLLADDQQHIGSVRWIGYIQPSQTGDYILSTSSDQQVVIELDGKIILNQSSMTEAIQLEKGKPYKIRIEYVPENKKNKDNLLDFELNWSISGGTAEPVPDNDFLLPDLSRKQDQEKIIPETSLFEEKGEEKNVSRSKRSLAVNPLLDTDDDGIYDEWETNGYTIQGQLAVRWNNSMKEQNYPKYVSNPYKSHTVADPYTDWEKASGRIDQAVKREAKNPLVAAYPVVGVNMERLIVSENQNISTGLGRTVTASTSASSTAGITAGIDATVGASLLGPSGSVTAHFSYTGSSTAAVENSSSNNWSDDLGINTAHSAYLNANVRYYNTGTAPIYNVTPTTNFVLDSETIVTVRAKENQLGDVLKAGGTYPEKHLNPIALNTLDDFGSQLIPINYDQTKRLENGNKLQLQTTQASGLYGKMNSNGGLNIHPSQEWEPVRAQIESVSAGIVLDTGEEVLERRVATRDDRDPEDLTPEITIGEAIKIAFDTTEQGGKLQYKDTPLNESLVELIVDESTAREIKAQLDGNPGLEKKIYNVKLKRGMNIMLKKPIWYSDFDTHQHNWSNITIAPEEGITGNAGKISQGSVQPAFLRYQTVEDFKNLKPNTRYKLSASIRYLDLEPGGVTGAYIRVNDLPNNEYLIRSNLYERIESTFTTGIIPSGITDFRIATTGSRDMLLDDITLVELGPSN

SEQ ID NO: 102 - protein, 278 aa, Bacillus thuringiensis
MDHMAIINLANELAIWAKRWCAEKGYTYESSGLQAHTGNYGRIYNYNISVPDPIVTDNPTNTAMARGTTPNSTSQPIVRTITFNETLTDSQSTTTEHGITAGVSATVKSEAGFVFAKVGFEVTVSFQYNYTTTNTYTTETSRSWTDSLQVTVPPGYVTEHTFIVQTGPYSKNVVLEADIAGHGWFNYRAPGYTATGIVNITRVLYDNKVPGITPYPDDFYARFRGSGKLEGKMGLQSFVNIVERPLSGRAGQVREYQIPVSLQSGLGIPIFDPVVSLQ

SEQ ID NO: 103 - protein, 301 aa, Bacillus thuringiensis
MYFRLKFSKYSKSSKAEKEEVNGMAIINLLSELEAYGRNYAASHQYRYETSYSDDMDPLRISAINETVPDRIVQDGIKNIVLDRRNIRNTTSSELNGVFSFSNTYTNKNSTQTIDGVTAGTNITIKAFANLMFAEVGLSGNIAFEGNITNSNVVTLDTNQDFTDTRNISIPPHHQATGLYMLQQGSFEKMTVIECVVAGNGIIRYTRYFPDGSATEVRQRVSIVDVLQANGTPGFTVSPGQQQAYFTGEGRVFGQLGLQTFIDVVIEPLPGYSGQRQQYQIPVTGRSGLDIPVFDALGVRQ

SEQ ID NO: 104 - protein, 1364 aa, Bacillus thuringiensis
MSVKWVCMDESKKTIGGLCMNQNYNNNGYEVMDSGGMYHQPRYPYAKAPGSEFQQMNYKDWMNQCKWGESGELFANDLGPVRDMLIIGTGIGWALLGFVPGIGPILSAVAGVLNVAIPYLWPEDAGTPGTPEAQFSWDQLMTAAEQITNTAINAQVRAEAITELQGIQETIRLYRGAACDWKNDPNNAQLKETLRTQFIATNTVIFNRMPSFRVAGFETSLLPTFVQAANLHLGLLRDGAKFGLQWGMDPATVNRYYGYLTSNIATYTNYCTSWYNTGLQQQYNTGNWDKFNNFRRDMTISVLDIVAAWPTFDTNLYAVPTSSQLTRTVYTPLQGNLGANALSPEASPSIDVIEENLVDTPGLFKWLHKVSFEAINGLQSTVIKGRGIGYRYTMNDSIIDGGYQGEHGTMTETLPITYPTDRYTPVGDVWNVTNQLYQLRLVFPDRTDVISAVRGFLFRGTEPTVVSAIPVFYNPGYPIETTSGLPCRGMASVCETCEPNCMPQLPNGGSICESGLQYGNRLSYVGLGMLTAVPGYYVGSPTRYAAYFGYGWTHVSANANNLIDAEKITQIPAVKASSVTTGVQVIKGPGSTGGDLVKLGGGNILIATLALKFTVPAGQRQFRIRIRYASNMRTNLTISMPGYSGTYYPPTTTTDLTNLTYDKFSYQDIGTYSFNSSNDSITSLNLRVQGVGSISSVSSFLLDKIEFIPIQGSLEEYQAQEALEKAQKAVSALFTNDGKHTLQLNVTDYQVDQAARLVECMSDEIYPKEKMCLLDHVKCAKRLSQARNLLNHGDFESSDWSGAGGWSASNHVSVESDNPIFKGRYLKLPGANQPQFSNQVFPTYAYQKIEESRLKPYTRYRVRGFIGNSKDLEVFVARYEKEVHKKLHVPNDIIPSNPCTGEYPLEQGAYPVVTNQVIPQNMSCGPCDDGSQMMMQQTSMVCVDPHEWECHIDTGELDMNQNLGIWVGFKIGTTDGMALLDNLEVVEEGPLTGEALARMKKREHKWKQKWHEKQMKIEKAVQVARGAIQALFTNADQNQLQSSITLPEILRAETGVQKIPYVYHPFLGGALPTVPGEAYDIFQQLSNAVATARALYEQRNVLRNGDFNAGLANWNGTEGANIQQIGNASVLVISDWSTNVSQEVCVHPEQGYVLRVTAKKEGSGEGYVKISDGTEENTETLKFIAGEGTTSATSSMMPPRESYYEQDMANYSSEYTGASTYTTGNSMNYQSESFGINPYSDEYGQMNHPSAPYMGTDCGCGCRTNAYAGDYPTMSDASNGYERNAYPGSINQTNAMKSSCGCGCHTKTSVSETNMTTYPSESLSGYITKTVEIFPETNRVCIEIGETSGTFMVESVELIRMGCE

SEQ ID NO: 105 - protein, 683 aa, Bacillus thuringiensis
MLMNQNCKKDKLKLSDSGNRSCQPRYPFAKEAGSELQNINYKDWLVMCLDEKQSISNNQQRAVIDSALLTTSDITQTILNIGNTATSLRSPGMIAGQILLLVIRFLWTKISGQRKWTEMIKTVELLIKKALIQQMYDEAVSRLEGLEDVVDRYLKALDDLHIDPTNLTLQEEVRIRFDAADTAFIAAMPQFRPGVAGGDPQVLLLPVYTQAANLHLLLLRDAIAFGGEWGMDPATINTNYNVFLTRLSSYTDHCRNTYDSGLQKAHQLPPNYDYKSNDFPWISPSLKDGVWGFEEGYWRHVIDWNYFNNYRRDMTIIVLDVVSLWPTYDARMFPIPVKIELTRELYSELMGQNNGENQDQIESMIVRSPHLFTWLKTIKIGTKQPKSNCSQIDQYADIKVTLHHTNDNNLWDQTTVIAAPRTGEQVLENSSFGRVELSGTYSPYMFRFYTPYNGGGYFVGRDVPNTTCYSPHCNGWGGCSQSLSQIRWYIGTEIPSSSLPHSHRLSYIDGCTTTEPYFDKSTYISAWVFAWTHNSVGPNNTIFSDKITQIPAVKGNGLENIATGTATVRRGTGSTGGDFVQLIGNTPAGEGRLHISFTSLGARNYRVRFRYGSTTGGRLRVSTPTGNKYTNIQRTYGGGLPTAYNEFQYADLGVQTVYANHWFVIVAETGTNVIIDKIEFIPA

SEQ ID NO: 106 - protein, 1181 aa, Bacillus thuringiensis
MDNNPNINECIPYNCLSNPEVEVLGGERIETGYTPIDISLSLTQFLLSEFVPGAGFVLGLFDLIWGFVGPSQWDAFLVQIEQLINQRIEEFARNQAISRLEGLSNLYRIYSEAFREWEADPTNPALREEMRIQFNDMNSALVTALPLFSVQNYQVPLLSVYVQAANLHLSVLRDVSVFGQRWGFDVATINSRYNDLTRNIGEYTDYAVRWYNTGLERVWGPDSRDWVRYNQFRRELTLTVLDIISLFPNYDSRTYPIRTVAQLTREIYTNPVLENFDGSFRGSAQGIEGSIRSPHLMDILNSITIYTDAHRGEYYWSGHQIMASPVGLSGPEFTFPLYGTMGNAAPQQRIVAQLGQGVYRTLSSTLYRRPFNIGINNQQLSVLDGTEFAYGTSSNLPSAVYRKSGTVDSLDEIPPQNNNVPPRQGFSHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGNNLQSGSFRTVGFTTPFNFSNGSSVFTLSAHVFNSGNEVYIDRIEFVPAEVTFEAEYNLERAQKAVNELFTSSNQIGLKTDVTDYHIDQVSNLVECLSDEFCLDEKKELSEKVKHAKRLSDERNLLQDPNFRGINRQLDRGWRGSTDITIQGGDDVFKENYVTLLGTFDECYPTYLYQKIDESKLKAYTRYQLRGYIEDSQDLEIYLIRYNAKHETVNVPGTGSLWPLSAPSPIGKCGEPNRCAPQLEWNPDLDCSCRDGEKCAHHSHHFSLDIDVGCTDLNEDLGVWVIFKIKTQDGHARLGNLEFLEEKPLLGEALARVKRAEKKWRDKREKLELETNIVYKEAKESVDALFVNSQYDRLQADTNIAMIHAADKRVHSIREAYLPELSVIPGVNAAIFEELEGRIFTAYSLYDARNVIKNGDFNNGLSCWNVKGHVAVEEQHNHRSVLVVPEWEAEVSQEVRVCPGRGYILRVTAYKEGYGEGCVTIHEIENNTDELKFSNCVEEEVYPNNTVTCNDYTATQEEYEGTYTSRNRGYDGAYESNSSVPADYASAYEEKAYTDGRRDNPCESNRGYGDYTPLPAGYVTKELEYFPETDKVWIEIGETEGTFIVDSVELLLMEE

SEQ ID NO: 107 - protein, 1131 aa, Bacillus thuringiensis
MNQKNYDIMGASTNATAELTENYNTIISPYGAPTSVTTTIEITGTILSDLGVPGASSISLLLNKLLSILWPDDTNTMWGTFAKETAYLLNEVLSPNDPVVIDADNKLEGLKNTLDLYLEALKEWKNDPQNPASQERVRTRFRNVDDDFTHDMPSFARAGYETKLLTVYAQAANLHLLLLRDASMFGEGWGMTQVNINDNYNRQLRLTAQYTDHSVKWYNAGLEKLKGKLTGENWYTYNRFRREMTLMVLDVVALFPNYDTRMYPIATTSELTRIIYTDPIAYTQDHPWYKITSLSFSDIENSAIPSPSFFRWLKSVSINSQWWGSGPNQTYYWVGHELVYTNSNYNQSLKVKYGDPNSYIEPPDSFNFSSTDVYRTISIAKNSISNYIVSEVRFNSISNTNKISEEIYKHQSNWPLKETKDSIAELSIAANPPTTFGNVAEYSHRLAYISEAYSSHNPSKYPAYIPVYGWTHTSVRYDNKIYPDKITQIPAVKSASVEGGTWKNVVKGPGFTGGDVTTAVSPANLIDVIKIHVTLDSNSLSQKYRARLRYASNAYVAATLYTNTSSNYHFELTKGTTEQFSTYNSFQYVDIPGSIQFNNTSDTVSVYLHMDSTTNASVQVDRIEFIPVDINYDERVQLEKTQKAVTALFTAGKHALQTDVTDYKVDQVSILVDCVSSELYPNEKRELQNLVKYAKRLSYSRNLLLDPTFDSINSSVENGWYGSNGIAIGNGDYVFKGNYLIFSGTNDTQYPTYLYQKIDESKLKEYTRYKLRGFIENSQDLEAYVVRYDAKHETLDVSNNLLPDVLPVNACGEPNRCVALQYLDKNPRLECSSIQDGILSDSHSFSLNIDTGSIDLNENVGIWVLFKISTPEGYAKFGNLEVIEDGPVSGEALARVKRQETKWRNKLAQLRTETQAIYTRAKQALDNLFTDAQDSYLKIGATFAAIVAARKIVQSIREAYMSWLSVVPGVNYPIFTELNERVQRAFQLYDGRNVVRNGQFLNGVLDWIVTSDVSVQEENGNNVLVLSNWDAQVLQCLKLYQDRGYILRVTARKEGLGEGYITITDEEGNTDQLTFGSCEEIDTSNSFVSTGYMTKELEFFPDTEKVHIEIGETEGIFQVESVELFLMEDLC

SEQ ID NO: 108 - protein, 1204 aa, Bacillus thuringiensis
MNIQNSNDANTNRILNNGLSVSSTANLLELVQQGRSDYAGKCYSGYIDLIGEPRSTPISNRFSNSILPNTITNDPRIVETCGNGSIVDNTVQDSITTVIDITNIILDLFNVPIVGPVLSIVNRLINRLWPSNYGTAIWEALMAEVEKIVDKKIDEAVKSKALSELEGLQRIYSSYQSDLERWLGDRDNPEYQEIIRQQFNVVNNFFAYQMPSFAVSGFEILLLSVYTQAANLHLNLLRDITVHGTGWGYSEGTVERYNQLQRCLITAYVDYCVDQYNLELEKLPKETLKNWVDYNRYRREMTLSVLDIVSLFPNYDASVYDLPINAELSRQVYTDPLGSYLPYNTANPISWYDMKSYIHPNFWQIDKYFIKPPNLFTFAEKLIMYSGYRTDVDPIFYYYWSGSKLESRRVHGNEIITTISGDISQSITLVNVDFKDSDIYKITTNYIGQYTGSLLGTNPITFSLTNSNGQTERKYEYSKLLMPGKEKIYYSQDEIPPNIETGEPDYVAYSHRLSYVSAFNPNFTSGKKIGTVPIYGWTHTSVSRDNLIYPDKITQIPIVKSYEIGEYYKVMQGPGFTGGDILTKTYPVQNPSGSTLAARIRVSTAGIHLNQRYTLRMHYAASGSVYDAMIIKPGQSEGGYHMRLNPTMENGETLTFNSFTSIGMNSQVLTSSQTDLTLYIKSMSPSTPGTIYIDRIEFIPVDNNYEAEQNLEKAQKAVNALFTAGRNALQTDVTDYKVDQVSIVVDCVSKEVYPNEKRELQNLVKYAKRLTNSRNLLVDPNFTSINSEGVNGWYGSNGIVIGHGDDVFKGNYIQLAGTNDAQYPTYLYQKIDESKLKEYTRYKLRGFIKSSQDLEAYVIRYDAKHETLDVSNNLFPDISPVNACGEPNRCGALQYLDENPRLECSSIQDGILSDSHSFSLNIDTGSIDFNENVGIWVLFKISTPEGYARFGNLEVIEDDTVIGEALARVKRQETKWRNKLTQLRTETQAIYTRAKQAIDNLFTNAQDSHLKIGATFASIVAARKIVQSIREAYMPWLSIVPGVNYPIFTELNERVQRAFQLYDVRNVVRNGRFLSGVSDWIVTSDVKVQEENGNNVLVLSNWDAQVLQCLKLYQDHGYILRVTARKEGLGEGYITITDEEGHTDQLTFGTCEEIDASNMFVTTGYMTKELEFFPNTEKVRIEIGETEGTFQVESIELFLMEDLC

SEQ ID NO: 109 - protein, 632 aa, Bacillus thuringiensis
LNSKSIIEKGVQENQYIDIRNICSINGSAKFNPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNANYLTALAPMQKIPAPNDRWRILTINWDARNNKLTARLQEKSNDDPTRSATPNYQTWELLNPAFDLNQKYTFVIGSATGAANNKHQIGISLFEAYFTKPTIVAHPVDIEIGTAFDPLNYEPIGLKATDEVDGDITKDITVEFNDVDTSKPGAYRVTYKVVNSYGESDETAIAIVVYTKPTITAHDVAIKKELAFDPLNYEPIGLKATDPIDGDITDEISVKFNNVDTSKPGKYHVTYKVVNSYEKSDEKTVEITVYTKPIIEAYDVEIKKDTAFDPLNYEPIGLKAIDPIDGDITDKVTVESNDVDTSKPGAYRVKYKVVNNYEESDEKTIAVTVPVIDDGWENGDPTGWKFFSGETITLEEDEENALNGKWVFYADKHVAIYKQVELKNNTPYQITVYVKPEDEGTVAHHIVKVSFKSDSAGQESEEIINERLIDAEQIQKGYRKLASIPFTPTTIVPNKKPVIIVENFLPGWIGGVKIIVEPTK

SEQ ID NO: 110 - protein, 632 aa, Bacillus thuringiensis
MNSKSIIEKGVQENQYIDIRNICSINGSAKFNPNTNITTLTEAINSQAGAIAGKTALDMRRDFTLVADIYLGSKSSGADGIAIAFHRGSIGFIGTMGGGLGILGAPNGIGFEIDTYWKASSDETGDSFGHGQMNGPHAGFVSTNRNANYLTALAPMQKIPAPNDRWRILTINWDARNNKLTARLQEKSNDDPTRSATPNYQTWELLNPAFDLNQKYTFVIGSATGAANNKHQIGISLFEAYFTKPTIVAHPVDIEIGTAFDPLNYEPIGLKATDEVDGDITKDITVEFNDVDTSKPGAYRVTYKVVNSYGESDETAIAIVVYTKPTITAHDVAIKKELAFDPLNYEPIGLKATDPIDGDITDEISVKFNNVDTSKPGKYHVTYKVVNSYEKSDEKTVEITVYTKPIIEAYDVEIKKDTAFDPLNYEPIGLKAIDPIDGDITDKVTVESNDVDTSKPGAYRVKYKVVNNYEESDEKTIAVTVPVIDDGWENGDPTGWKFFSGETITLEEDEENALNGKWVFYADKHVAIYKQVELKNNTPYQITVYVKPEDEGTVAHHIVKVSFKSDSAGQESEEIINERLIDAEQIQKGYRKLASIPFTPTTIVPNKKPVIIVENFLPGWIGGVKIIVEPTK

SEQ ID NO: 111 - protein, 318 aa, Bacillus thuringiensis
MKFNKLMVSGIAFVCSSTFFTAYIQAAEIEENKNSTTALSESREELFGIVDVDKSFDKMAQYYYFKNLQGKIENGYKFTNYKGSSTNLDKFKTTSDKVSDLQITGLLPEYIGGNTFPNHTEQEQTFSTTSYARTITESVTTTTQSGFSVSGQGGLLNIPIIFPNGTSITASINTSSTLAKQESDTRTLTAPSQAVKVPPGKTYRAEVKLVRKSFKANVGFNGTIAPPLSTDIKMNARWEGAGGRPNKTVTKSYATQTLYRDMTPSQQKDLGITFNSTTGQFDVNGKAVIDGIAGSEMEVAIYDITNARTPKLVSKTYY

SEQ ID NO: 112 - protein, 673 aa, Bacillus thuringiensis
MAFKNDETPNSTDSNTEDISTLKTAETSVSGPAKLYSSCSLTEKSLYEIENEWKRWSKGNDFLYIPPVVGTVSSLILQKIAGMIGDKLLKSVFEKLFPTPNPVTMLEILEAVQKLLDERLSQEVHQRITLELEGLQQNITNFLEDVEDFEGLIIIDKLEDGNQPLAIIDSINTLNQLFDNRMPQFRNPSYKVLLLPLYAQAANLHISFLKDVVDNASKWGLTASQIKTYTNRFLDKISEYSNYCIETYQHDFQSKFSQKLQDVLKYRNFMTINVLDYTSLWPMLRFTKPFNIRTSSNLYEMGPTPGEDFIFPYSSWANFNRIFQGFPNKELQSISATNRFYRAYKQSGGWSMLAITEVMGNLTCNYSGGKSIKFGYESLPSCPDDTGVQRCDAVKEEINDFSRSQLNQVLLSSSISTTNPPYMSAKYLQNVKLSNGTVYNLINGEYGSWISYPNYTIRNIIGWAKFMESKATNIIEGPSNQYEGSLRGNLSTSIVSFQRREYDPYTIYNGVKRHTIPSHTRGVLISPLEYSDTFNVGTGTKGKFVIHERHGNNGDAVIIPKTNGGYRHGFEYILFNPYGTNLNIDIYVKVSVPVQTKLVYLINGAGLTKEIVTSTDNDGVTDNGQKSKIIKLYSNKQLVPGNTTFSIRNGGLGDIYLEGIVVVPNGSSLISRI

SEQ ID NO: 113 - protein, 1168 aa, Bacillus thuringiensis
MTLNNNEYEIIDTPSRTSVSNESFRYPLASNQSTSLQNRNYKDWLNTLEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEILLLAVYAQAANLHLLLLRDASLYGADWGMEPYDIANYYNRQKERTATYSNHCMEWYKKGLDELWSAGGYGGDVWQDYNDFRREMTLSVLDFVALFPNYDTHLYPIEVKGELTREIYTPGINIDIDRGRLGKVTLENALVNSPRLFSWLKEIQLFTNINFNPRWKFLSATRIGYKLTGYRSVNFEPYEGFYFEGLFQSNFTLNDYQEIYIVDVTRFGSLYDTPTAITAMTFFKDDNTTFNYSSNTPSGEPMITSGFYLPGIDGSEEPTSNNFSHRLSTINTYNTTNQTFYHTFGWTHVSVDRNNTIVSNKITQIPFVKANTGNVVRGPGHTGGDLVVFKPAARPDIVLRVGNTRLQSYRVRVRYASNADISLELDTTYEKTNIHLQKTFNSSEAEDLTYDNFQYAEADNIVWLGQDLSQYIEFQNAITNDSTAIAYFERVEFLPVGATYEAEQDLETAKKVVNALFTNTKNALQMSVTDYEVTQAANLVECVSDELFPNEKRLLFDAVKEAKRLSGIRNLLQDSDFQEINGENGWVGSIEIEIREGDTLFKGYSLRLPSAREIYMEMFPTYLHQKIEESRLKPYTRYRLRGFVSSSQDLEIFSIRHETNRIVKNVSDDLLPNLSSYYTCGGVNRCSTQKYVYNRLEFQNSLSSGNRYSDAHSFSIPIDTGKIDLNDNTGIWIAFKLATTGGYATLGNLELVEEAPLIGDTLERVQREDQQWKSQMTRKREEAERKYMAAKQAIDRLYADYQDHQLNPNVEITDITATQHLVQSLPYVNNDVLQEIPGMNYTRFTELTNRLQQAWELYGLRNMIANGDFRNGLNDWDATSGVNIQQINHTSVLVISNWDAQISKQFTVQPNQKYVLRVTVRKEGSGDGYVTIRDGGNHTETLTFNTCDYERSNVYNEKVFQSNDYGTNNVYHTQTTNANRYTTNSLYNDGTGYVTKTVEFIPYTEQVWIEMSETEGVFYVESIEFILEEV

SEQ ID NO: 114 - protein, 1169 aa, Artificial Sequence
  stop codon replaced in Axmi120
MTLNNQNEYEIIDTPSRTSVSNESFRYPLASNQSTSLQNRNYKDWLNTLEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEILLLAVYAQAANLHLLLLRDASLYGADWGMEPYDIANYYNRQKERTATYSNHCMEWYKKGLDELWSAGGYGGDVWQDYNDFRREMTLSVLDFVALFPNYDTHLYPIEVKGELTREIYTPGINIDIDRGRLGKVTLENALVNSPRLFSWLKEIQLFTNINFNPRWKFLSATRIGYKLTGYRSVNFEPYEGFYFEGLFQSNFTLNDYQEIYIVDVTRFGSLYDTPTAITAMTFFKDDNTTFNYSSNTPSGEPMITSGFYLPGIDGSEEPTSNNFSHRLSTINTYNTTNQTFYHTFGWTHVSVDRNNTIVSNKITQIPFVKANTGNVVRGPGHTGGDLVVFKPAARPDIVLRVGNTRLQSYRVRVRYASNADISLELDTTYEKTNIHLQKTFNSSEAEDLTYDNFQYAEADNIVWLGQDLSQYIEFQNAITNDSTAIAYFERVEFLPVGATYEAEQDLETAKKVVNALFTNTKNALQMSVTDYEVTQAANLVECVSDELFPNEKRLLFDAVKEAKRLSGIRNLLQDSDFQEINGENGWVGSIEIEIREGDTLFKGYSLRLPSAREIYMEMFPTYLHQKIEESRLKPYTRYRLRGFVSSSQDLEIFSIRHETNRIVKNVSDDLLPNLSSYYTCGGVNRCSTQKYVYNRLEFQNSLSSGNRYSDAHSFSIPIDTGKIDLNDNTGIWIAFKLATTGGYATLGNLELVEEAPLIGDTLERVQREDQQWKSQMTRKREEAERKYMAAKQAIDRLYADYQDHQLNPNVEITDITATQHLVQSLPYVNNDVLQEIPGMNYTRFTELTNRLQQAWELYGLRNMIANGDFRNGLNDWDATSGVNIQQINHTSVLVISNWDAQISKQFTVQPNQKYVLRVTVRKEGSGDGYVTIRDGGNHTETLTFNTCDYERSNVYNEKVFQSNDYGTNNVYHTQTTNANRYTTNSLYNDGTGYVTKTVEFIPYTEQVWIEMSETEGVFYVESIEFILEEV

SEQ ID NO: 115 - protein, 1169 aa, Artificial Sequence
  stop codon replaced in Axmi120
MSPNNQNEYEIIDTPSRTSVSNESFRYPLASNQSTSLQNRNYKDWLNTLEGGNNQGFINIEGRLSLEQVLAVSAGVASYILSNLGPFGVFFSYIIGAFWPTAPSDTRVWEAFMELIEARIDQKIQESTRKDAIARLQGLGAASEVYQESLESWLENQNDARAMSVVRQQFVAFELDFVTAMPFFERSGDEILLLAVYAQAANLHLLLLRDASLYGADWGMEPYDIANYYNRQKERTATYSNHCMEWYKKGLDELWSAGGYGGDVWQDYNDFRREMTLSVLDFVALFPNYDTHLYPIEVKGELTREIYTPGINIDIDRGRLGKVTLENALVNSPRLFSWLKEIQLFTNINFNPRWKFLSATRIGYKLTGYRSVNFEPYEGFYFEGLFQSNFTLNDYQEIYIVDVTRFGSLYDTPTAITAMTFFKDDNTTFNYSSNTPSGEPMITSGFYLPGIDGSEEPTSNNFSHRLSTINTYNTTNQTFYHTFGWTHVSVDRNNTIVSNKITQIPFVKANTGNVVRGPGHTGGDLVVFKPAARPDIVLRVGNTRLQSYRVRVRYASNADISLELDTTYEKTNIHLQKTFNSSEAEDLTYDNFQYAEADNIVWLGQDLSQYIEFQNAITNDSTAIAYFERVEFLPVGATYEAEQDLETAKKVVNALFTNTKNALQMSVTDYEVTQAANLVECVSDELFPNEKRLLFDAVKEAKRLSGIRNLLQDSDFQEINGENGWVGSIEIEIREGDTLFKGYSLRLPSAREIYMEMFPTYLHQKIEESRLKPYTRYRLRGFVSSSQDLEIFSIRHETNRIVKNVSDDLLPNLSSYYTCGGVNRCSTQKYVYNRLEFQNSLSSGNRYSDAHSFSIPIDTGKIDLNDNTGIWIAFKLATTGGYATLGNLELVEEAPLIGDTLERVQREDQQWKSQMTRKREEAERKYMAAKQAIDRLYADYQDHQLNPNVEITDITATQHLVQSLPYVNNDVLQEIPGMNYTRFTELTNRLQQAWELYGLRNMIANGDFRNGLNDWDATSGVNIQQINHTSVLVISNWDAQISKQFTVQPNQKYVLRVTVRKEGSGDGYVTIRDGGNHTETLTFNTCDYERSNVYNEKVFQSNDYGTNNVYHTQTTNANRYTTNSLYNDGTGYVTKTVEFIPYTEQVWIEMSETEGVFYVESIEFILEEV

SEQ ID NO: 116 - protein, 385 aa, Bacillus thuringiensis
MFNIKYSTSQRKLNLIKALFKNGILSVYTNIYVCERFNLNFSVKEGIGYMKNNKRLRKKILAFGAIASIGTTLVTASPLVISAKTEYNNEQQLITQINQKENSFPNVALGTQWLFSYYDKYLRANGLIRAAPFVTVKDLEVKNSYGQLAMEPQVMSTTPLWAGQSDLENTTDREQTLNSMEFRKTYSNTTSSSTEHGFMLGTETTVKTGIPFLAEGNITLKAEYNFNDTQGYETSETVEYVAPSQQVIVPPQTIARITATLDVKKIKGKMDLYSEIGLNKEEYGYDKIPTYHVFEGMKDPITLGSIYDDAYKQAQKDGFSEIPEIKSLSRSFNNPDYFLASGVGSFESEYGSVFNVKVEYINIKTKKIEKTENIVVQPKINSLKE

SEQ ID NO: 117 - protein, 333 aa, Bacillus thuringiensis
MYQMKNNKKIRKKFLALSAIASIGVTFATISPELTSAAQLDTIQKTSSINEFAGETKTIQDWQTPLTEAELVFGKHLDSQREYRTSIGDAKYHMKDIKFHSNAVSPDGPPNFTDVGDVFVGHATLNNDLDEKIDLKTDSFSRTLTDSVTTSTTHGFKIGEKTSGKISFPIGEMSQELSLEYNFSTTDSQTNTDSRTYTIPSQTIPVKPHSSVEVIVMLKRSKATGNVNLLTKMSGRVDNWNHCYYPLPGEQYGKNYVHSGSIASMVKYAKNFEKLPNLSVNLDDTINLIGKGTYEAEFGTEYSVTVRPIDKKGKYTGADYTYTVKPEVTKAEA

SEQ ID NO: 118 - protein, 304 aa, Bacillus thuringiensis
MTLTMSIIDIKKDVIDHAKWNASTYYNANPDTFCEETIYDFSVFDLKVEPTVTAIDVRPTLRVSISKTIENPTSQSQFREVSFTENVKNTYTTYTKEGFLLQNPITEIHSFPITLTFDMYTVKQKINVNVPGEYHYSSLDPITMTRERLWELTSAISIPPKTRVTATLMVYKGTFNVPIRLHATIRGAYAYNGRYYANSVQYADWFQKQHIAFHTASSLFIDKDQWAGYKTMYVSASKDDDSLHINGSGINKVTCCLYAIIHFEEKSMFYNQMVKKEYDSPIYFANTMLQPGMLGNEIPIINPI

SEQ ID NO: 119 - protein, 1099 aa, Bacillus thuringiensis
MENSPRNYPISYTTSSTQEENFQFISKLDRKIELLNKLKLGLTTGQYLDIILEIFKDIKARKIDYLSFINISLPLITIGVPKVGITVPFLSLFFPKTSGIFSTVEIPDVFTIIKQDIQNIFKLILTDEQINNLNTMVLKLEVSMKNYIDILNGIKSNPTNFFAIYNNTDTIITEIIDEFIKFNYTELHITYFSVFATIHLMMHRDVIIHGEKWGFTEDFINQKKADIKKMIQRYISIGDILFERGLNKLLNNEQTHNGIDSCIQKLALYGPNIYRLWPTLDPDTYPVYTQIEQKRVLFNSDITRDTKNQDKINIAEDNEGIFNQYKHSTTLDNIDVCKENLIYNTSIDFNRNGLNNKCFSHNIIGDIDSGKDTFLSKIKGVVVANYSNNQGDLVTEWINGGSTVKLGQTQIVAIPITVLDNHVYQIRLRYATENHVGANMWMCIQNNQTGDTPLNTKLSFAAPIDSNSIKGKYGKYILNIIENDCENKDITLNAGSYTIFIKNIMEKNLFLDRIEFYKNTIKNNTLIILPARELVSPSGGGPGWTNLWVAETNQIGKAFEAENSVSKGEYKFYFNGTLVGSTQGNTFYENFDTVQIYFYNCVVDIFNSFTGANIWIEKPSQEYFKSNLDLERIRKQVNSLFIGNLHKKLSPNTTDYLIDQVALKINVLSNEIFGKEKMELRKLVNHAKHLSKARNLLVGGNFENLDNWYLGRSVIQIEGGKGYHLLLPPPIDYLSYAYQKIDKSKLKQNTRYIVTGFIAQAISLNIIVSCYENEINQVLNVPYAEVFPIHSEAITGVCISNLPFKFNNKKGVDSHLFRYSIHVGSLQTESNLGIELGLRITSPTGFAKLNNIEIYEDRPLTNNEISRIERTEHKWKKVFIQSQTDMSAKLQPVIHQINNLYQNKDWNESIKSTVMFQDVQAIKLPDLPRETHWLMADRTDVHYAIMQQMKRAIHHAFSQLNERNLLLNGNFAEGLINWIPEGDCQIVLSENQNKAVSLLHWDASITQSLKITNFNPDQEYQLRVYGKGNGTLMIQHGNKIESMSFSSQVFMSKPSHYIVLETATIEVYIVSEGTEFIIDNVQLTQISREEIDDFDPNIV

SEQ ID NO: 120 - protein, 673 aa, Bacillus thuringiensis
MNNNEYEIIDLHASLYSSNRNINNSRYPYTNNPNRSLQNTNYKDWMNMCQQNQQYGENSQTFASAETIAAVSAGSIVVGTILGAMAFPPLGAAAIISFGTILPIIWAPGQDARTVWKSFLTIGNRPFGLPVDEAIVSLLYGRVQALRVEVEDYQRYFDIWYANPIPQNASPLKSKFLTLDTLIIGALEELTKDYSITLLPGYAQVASWHLMLLKHAAVYYDRWAASSNLSIQSIYPQDYTSNLQTCLTNCAKESENKVSSKYYKCILKCRINEYINYCSTKYQEGLNRLKNSSGINWNIYNTYRREMTLTVLDLIATFPNFDPEKYTIATNSQLTREIYTEALLQEPGIPRPINERESQLTRPEGLFTHLDLLQFHTQINSDFVPIRGLRGVQNFMSFIGGNTFNGPIHQPATPPSSYIEIIREQPLNVSGESNQIYKISVTQAPSSYRTTSIDFNLINGSTRQYRSGSSHVGSEITIFEFPKFPKDKIPPNRSEYSHVVSYVKVGPEETPGVIFYTQLSFAWTHTSVDFNNIIYNKSITQIPAVKAYELSTDSKVVKGPGHTGGDLVELKDYMFFKLLVPQGSVGSYKVRIRYASNAPNQNIGLTRGFYQDQSLPQTFNHSNYNDLKYSDFQYATFPLPVTYTGALTDTISLHGLRNNPNRIFIDKIEFIPN

SEQ ID NO: 121 - protein, 542 aa, Bacillus thuringiensis
MSPMFTSSTKNTLKIETTDYQIDQAAISIECMSDGQNSQEKMMLWDEVKRAKQLSQSRNLLYNGDFEDSSNGWTTSDRITIQTNNPIFKGHYLNMSGARNIDGSIFPTYIYQKIEESKLKPYTRYRVRGFVGSSKDLKLMVTRYGKEIDAMIDVPNDLAYMQPSPSCGDYRCESSSQYVSHGYPTPTDGYASDRYACQSERGKKHVKCHDRHPFDFHIDTGEVGTNTNVGMDVLFKISNPDGYATVGNLEVVEEGPLTGDALAHVKHKEKKWHQHMEKKRWETQQAYEPAKQAVDALFTNEQELHYHITLDHIQNADRLIQAIPYVYHAWLPNAPGMNYDVYQGLNARIMQARYLYNARNVITNGDFTQGLTGWHVTGKATVQQMNGASVLVLSNWSVGVSQNLHVQDHHGYVLRVIAKKEGPGKGYVTMMDCNGNQETLKFTSCEEGYMTKTVEVFPESDRVRIEIGETEGTFYIDSIELICMKGYTSNNNPHTGNMYEQEYTNNYNQDSSSMYNQNYTNNDDQHSGCTCNQGHNSGCTCN

SEQ ID NO: 122 - DNA, 111 bp, Artificial Sequence
  intervening region between Axmi125 and the downstream Axmi126
tgaattcattcccattaaaggatctgcttttgaatatgaaggtaatcaagcattagaaaaagcggaaaagtctgcgggtaatttatttagtaataaatagtttgaaaggtt

SEQ ID NO: 123 - protein, 4 aa, Artificial Sequence
  ER targeting peptide
KDEL

SEQ ID NO: 124 - DNA, 3693 bp, Bacilllus thuringiensis
atggttatgtctagtgtaagtatagggggcaaaaagatgagtcaaaataatcaaaatgaatatgatattatagatgtatcatccggtaactttatatccaatgattctgttagatacccgttagcaaacaatcccaatcatacattacaaaatataaattataaagattatttaaatatgtctgaagggaatagtgttgaattatttggagacagtcaagcatttaatagagtggctactgcccaaacaggacttgcaattgttggaggagctttaggggctttaggagttccttttgcaggggagatagcgggcctttttagttttattctcgacctattttggccatcgcaagaaactgatgtatgggaaatgataatggatcaagtgcaaggactcattgatcaaagcattacagcgaatgtaagaagccaagcaatcgcaaaattagagggtttagggagaggtcttgaagcgtatcaggaattactagttgcttggttggaaaatcggaataacgcaagaactagaagtttaataaaacagcaatatgtagccttagaacaaattttcacaactggtttaccagaattttcagtacaaaatcaggaagtgccactattaggtgtttatgcacaagctgcaaacttacatttgttattattacgagatgtttctatttttggagcagagtggggatttgaagattatgaaatcgatgtcttctataatagacaaatgagatacaccgctgaatatgccaattattgtgtagagtggtataataaaggcttagatagattgaaaggtacagatcggataagttggatgaagtatcaccaattccgtagagaaatgacattattggttttagatattgtagcgttatttccaaattatgatgcgcgtaggtatccattggaaacagaagctcaacttacacgagaggtatatactgatccaattgtatataatccagaggaatttttaggtggattttgtaattcttggactagtgacaatcaaagtgatttttctcaaattgaaaatgctgtaattcgtccaccacatgtttttgatactatcgcttctttagaaataaatacagcgagagggcgtattgctttaaataatacagcgtacattgacttttgggcagggcattctttgacattccgttatccgaatgattcagcaagacatcaagttcaatatgggacaattacttctgaaaaaaatagcttcccattcgaagtaacagatgttgtgcaagttaacacaactgctgcaaatttagctaatgcctaccaacaggcatatggagctccacgtgcggttttccaattagtaaataggcttaacggggctgttggctcccttacgtatagtaaaacccatacagctatacaagcatgtacacagtcattaaatacaaattctgaaatacctcgtctacctgtatcacctggagtaacaaatttgagtactttatatactcataggatatcacatattacttcatataatttctcaaataatcttgccggcaatcgtaatcgctatgggaatttccctgtatttgtttggacacatcgaagtgcagaaattgataataaaatttacgcaaataaaattactcagatccccgcagttaaagctttatgggcaagttcagaaccatatccagttgtacgtggaccgggctttactggaggagatatagctcgattacctaacaatccaaatatagggttgagatttcttttagacccagaaccaggtgtattatttaacagacgttttcgtgtacgcattcgctttgcctgtgattcaggagctagggttatacttacagatgaaacaggaattaattctgaaacaattgtacttaatcaaacaatgacaactgagaatcctagaaagtatgatgatttccaatatatagaatcaagaaatgtgtatacacttactaggttccctggcccttggatttggagattaggggctcaaagtgctgatcaaactagaaatgtatatattgatagaatcgaatttattccattaaacccagcgcttgaagcagaaaatgacttagagactgcaaagaaagcagtgaatgccttgtttacgaatagaaaagataccttacagataagtgtgacagattaccaaatcaatcaagctgcaaatttaattgaatgcgtatccgatgaggtatatccaaatgaaaagcgattgttgtttgatgcagtaaaagaggcaaaacgacttagtacagcacgtaacttgctggaagatacggattttcatgcaataaatggagggaatggatggaccggaagtacgggtattgaaattgtggaaggggatcttctctttaaagatcgctcgcttcgacttccaagtgcgagagaaatagagagagaaacttatccaacatatatatatcaaaaaatagaggaatcacgattaaaaccaaatacaagatatagtttgagagggtttatcggaagtagccaagatttagagatatatgtccttcgtcatcaggcatatcgtgttattaaaaatgtttcagataatctcttaccaaatatgcgccctatcaacgcttgcggaggagttgaccgatgcagtcaacaaaaatatgtgaataattcattagaattgaatagtagtttatcaaatggaattggagcggctgactctcatgagttttcaattcatatggatacaggagaactgaattataatgaggatacgggtatttgggttgtatttaaaatcacaactacagatgggtacgcaacacttggaaatcttgaattggtagaagagggaccattatcaggagataccttagaacgtgtgcgaaaacaagaaaagcagtggcaggaccaaatggcaagaagacgtgcagaaacagaaacgagatatggggcagctaaacaagctattgatcgtttattcatagattatcaagatcaacaattatctcctggtacagatatctcggatttaacagcagcgcaaaatgtagttcagtccattccgtatgtatataatgatatgttaccagaaatcccgggcatgaactataccagtgttacagaattaaccaatagacttcaacaagcatgggatttgtatgaccagagaaatagcatacctaatggagatttccgatatggattaaatgattggaatgcgaaatctggtgcaaacgtacaacaagttaatcatacgtctgtgctcgtgattccaaattgggattctcaagcgtcacaagaaattaccgttcaaccaaatcgaagatatgtgttacgtgttaccgcaagaaaagaaggaagcggagatggctatgtaaccatccgtgatggagcaaaatatacagaaacgctgacatttaatacatgtgattataatggaagtaatgtatatcaggagcaagcattgtatacaaatgatgtatacaatacgcaatccgctaacatacagggttcgaatagtgcgtatcatacacaagcatccaatactgatagatataatatgaatggtatgtataatgaccaaactagctatgttacaaaaacagtggaatttattccgcatacggagcaagtctggattgagatgagcgaaaccgagggcgtattctatatagagagtgtagaattgattgtaaaagaaaat

SEQ ID NO: 125 - DNA, 3507 bp, Bacilllus thuringiensis
atgagtccaaataatcaaaatgaatatgaaattatagatgcgacaccttctacatctgtatctaatgattctaccaaatacccttatgcgaatgagcccacaaatgcgttacaaaatatgaattataaggattatttaagaatgtctgaaggttacgataataaatattttgcaaatcctgaagtgtttgctgcaccaggtgggattacaactggaattactatagttactaaattactggggtggttaggacttccatttgctggggaaacagggatggctcttaatttcattctaggtctattatggccaacatcaggaaacccgtgggctgaactaatgatattggtagaagaactcataaatcaaaaaatagaagaggctgtaagaaacaaagcactagcggatttggccaattcaggtagagccttacaatcctatttaaacgcatttgaagattggcaaaaaaaccctaatatctttcggagtaaagagttagtaagagaaagatttgcaaacgcggaacattcattacgtaccgaaatgagttcttttgccataagaggatttgaaattcctcttttagcaacatatgcacaagctgcgaatttacatttatttctaattaaagatgttcaaatttatgggaaagaatggggatatactcaagccgatattgacttattttatagagaacaagtagagtttacgaaagaatacaccgaacactgtattaatatttataatgatggtttaaatcaattaaaaggttcgaatgctaagcaatggattgcatttaatcgcttccgtagagaaatgacattgacggtactggatgtagttgcattattctcgaactatgatgtacgtatgtaccctataaaaacaactacagagctaacgagaacaatttataccgatccacttggttacacgaaaacgggttctagtagtacaccaccatggtataattatggatctagtttctcatatatagaaagtgtagcgattccagcccctagtctggttaagtggttaagtcagattgaaatttattcgaaatccgcaaaggctacaccgcaaagtgcggattattgggcaggacatacaataacatatcactatggtggagataatggtcaagcagtagctaattatggagatagaacgaatcctgtagctgtagatcgttataattttgagcaggctgacatttatagagtttcatcatctgttgcttcaagtacaactagtggtgttaaattattaactactaaggctatatttgatggcataaatacaaaaaatggactagtgagttacaggtatgaaaaatcatcgaacttttttaatgaactaaaagatacaattacagagctacctgttcagttatccagtcctcctacctacggggatgctgaacagtacagtcatcggctatcctatgtttctaatgctccaacagagtactcttcgggcggacatttaattttgggactaatcccagtactgggttggacgcatactagtttaactcaaacaaatcagatacattctgactcaattactcaaataccagccgtaaaggtttctaacttagagtcagggacttctgttgtagcgaaccctggttttacgggtggagatttacttaaaagaacaagtactggtagaatgggaactctaaaacttacagtagccggaatattatcaagggaaatgaccattagaattcgttacgctgctacaactgatttcaaattgcaggtgatttataaaggcattttgcaatctagttataactctaataaaaccatgaataaaggggaaaatttaacatatggaaaatttaaatttgcaaatttcactctgcctatcagtttactaatcccaagtgatttatcaatagatgtgcagaatttaagttcaggagaagaggtttatatagaccgaatcgaattcatcccagtaggtgcaacatatgaagcagaacaagatcttgaaaatgcaaagaaagcagtgaatgctttgtttacgaatacaaaagatggattacgaccaggcgtaacggattatgaagtaaatcaagcggccaacttagtggaatgcctatcggatgatttgtatccaaatgaaaaacgcttgttatttgatgcagtcagagaggcaaaacgacttagcgaggcacggaacctgcttcaagatccagatttccaagagataaatggagaaaatggatggactgcaagtacgggaattgaggttatagaaggggatgctgtatttaaagggcgttatctacacctaccaggtgcgagagaaatagatacggaaacgtatccaacgtatctgtatcaaaaagtagaggaaggtgtattaaaaccatatacaaggtatagactgagaggatttgtgggaagtagtcaaggattagaaatttatacgattcgtcaccaaacgaatcgaattgtaaaaaatgtaccagatgatttactgccagatgtacctcctgtaaacaatgatggtagaatcaatcgatgcagcgaacaaaagtatgtgaatagtcgtttagaagtagaaaaccgttctggtgaagcgcatgagttctcaatccctatcgatacaggtgaaatcgattacaatgaaaatgcaggaatatgggttggatttaagattacggacccagagggatatgcaacacttggaaatcttgaattggtcgaagagggacctttgtcaggagacgcattagaacgcttgcaaagagaagaacaacaatggaagattcaaatgacaaaaagacgagaagaaacagatagaaaatatatgatagccaaacaggcggtagaccgtttatatgctgattatcaagatcagcaattaaatccaaatgtagagattacagatattactgcggctcaaaacgtgatacagtccattccttatgtatataatgatgcgttcccagggttaccaggaatgaactatacgaagtttacagagctaacagatcgactccaacaagcatggagtttgtatgatcaacgaaatgccataccaaatggagatttccgaaatgaattaagtaattggaacacaacagctggtgtcaatgtacaacaactcaatggtacatctgtccttgtgattccaaattgggatgcacaagtttctcaacagtttacagtccaaccgaaccaaagatatgtgctacgagttaccgcaagaaaagaaggtgtaggaaatggatatgtaagtatccgcgatggtggaaatcaaacagaaacgcttacgtttagtgcaagtgattatgatacaaatggtgtgtataatatacaagcgtcgaatacaaacggatataacacaaatggtgtgtacaatgatcaaaccggctatatcacaaaaacagcggaattcattccacatacaaatcaagtgtggattgagatgagtgagaccgaaggtacgttctatatcgaaagtgtagaattaattgtggatgtagag

SEQ ID NO: 126 - DNA, 3498 bp, Bacilllus thuringiensis
atgagtccaaataatcaaaatgaatatgaaattaaagatgcgacaccttctacttctgtatccagtgattctgccagatacccttttgcgaatgaaccaacaaatgcgttacaaaatatgaattataaagaatacctgagaatgtctgaagggcatgatgctgcatatttttcaaatcctgaagcgtttgttgatacaaaatcgattcaggctataattaatgttattggtaaagcgctaggggctttaggagtcccaggtgctggaattatagcgagtttttacagttttattgttggtcaattatggccatcaaatagtgtatctttatgggaacaaattatggaacaagtggaagagctcattgatcaaaaaataacagaatacgcaagaaataaagcgcttaccgaattgaaagggctaggagatgctttggatgtatatcaggagtcacttgaagcttggttggaaaatcgcaatgacacaagagctagaagtgttgtttctaaacaatttatagctttagagcttgattttgttggagcaattccatcatttgcagtatccaatcaggaagtaccattattagcagtgtatgcacaagctgcaaacttacatttactcttattaagagacgcttctatttttggtgcagattggggattttcatcaagtgaaatttccacatactataaccgtcaagtacgacttacctctcagtattctgattattgtgtaaaatggtataataccggtttagataaattaaaaggtaccaattctgcaagttggctgaagtatcatcaattccgtagagaaatgacattaatggtactagatgtcgtggcgttatttccaaattataacacacaaacgtatccaatcgaaacaagagctcaacttacacgggatgtgtatacggatccggcagcatttaacaatgtatcagattatggattctgtaacccttggtcaactcatagtggcattcttttttctgaagttgaaaacgccgtaattcgttcaccacatttgtttgatatactcagttcaatagaaattaatacagctagaggggggattgcgcttaataatacggcatatataaactactggtcaggacattccctaaaatatcatgaaacgaataatccaacaatacgggcagttaattatggtcgaattacttcagaaaagaattcattggtattagaggatagggaaatttttgaaactatttcagttgtggcaaacctagccaatgtctaccaaaaagcatatggagttccggaatcttatttcaatatgacaagaagaggaacctcatcaacatcatattatttttattcaaaaacacatacaactccatatggatgtagcgatgtttatccatcatatagtgatatacccatagatagaaatgtaccggtagctgaaagctatagtcatagactatctcatatcacttttcattctttctctaagaatagtaatgcaatctatggaagttttcctgtatttgtttggacacatgttagtgccgatcttacaaatacaatttatccagacgcaattactcaactacccatggtaaaggcaaatgctttactttcaggtacttccgtgataaagggtcctggatctacagggggagatatattaagaagaacaagtgttggcagagtaggaaattttaaggttaacgtaaatggaccattaacacaacgatatcttgtaagaattcgttatgcttctacaactgatctagacttttacgtctatcgtggaggtaccactgtaagtaattatagatttaacaaaacaatgaataagggagcttctttaacttacgacatttttaaatttgcaagtttttctacccctttcacatttacaaaaacacaagatgaattaggaatatctatacaaaactttagtagcggtgaagaagtgtatatagacaggattgaagtcattccagtaggtacgacatatgaagcggaaacggatttagagatagcaaagagagcagtgaataccttgtttacgaatacaaaagatggattacgaccaggtgtaacggattatgaagtaaatcaagcggccaacttagtggaatgcctatcggatgatttgtatccgaatgaaaaacgattgttatttgatgcggtgaaagaagcgaaacgactcagcggagtacgtaacttgctgcaagattcagattttcaagagataaatggagagaatggatggacgggaagtacgggaagtacgggaattgagattgtagaaggagatgctttatttaaagggcgttatctacgcctaccaggtgcaccagaaattgatacagaaacgtatccaacgtatttgtatcaaaaaattgatgaaggtttattaaaaccatacacaagatatagattgagagggtttgtgggaagtagtcaaggattagaaatttatacgattcgtcaccaaacgaatcgaattgtaaagaatgtaccagatgatttgctgccagatgtatctctagtaagtgctggtgatggaattaatcgatgcagcgaacaaaagtatgtgaatagtcgtttagaaggagaaagaggtttaccaaatggtaatcgttctgctgatgcacatgagttttccattcaaatcgatacaggtgaaattgatttgaatggaaatgaagggatttgggttggatttaaggttgcgactccagatggatacgcaacacttggaaaccttgaattggtagaagaaggaccattatcaggagacgcattagaacgcgttcaaagagaagaacaacagtggaagattcggatgacaaaaagacgtgaagaaacagatagaaaatatacggcagcgaaacaagcggtagatcgtttatatgcagattatcaggatcagcaattaaatccgaatgtagagattacagatattactgcggctcaaaatctgatacagtccattccttatgtatataacgatgtgttcccaggcttaccagggatgaactatgcaaagtatacagagttaacgaatagactccaacaagcatggagtttgtatgaacaacgaaatgttataccaaatggagatttccgaaatgaattaaataattggaacacaacatctggtgtgaatgtacaacaaatcaatgataggtctgtcctcgtgattccaaattgggatgaacaagtttctcaacagtttacagtccaaccgaatcaaagatatgtcttacgagttaccgcaagaaaagaaggggtaggaaatggatatgtaagtatccgtgatggtggaaatcaaacagaaacgcttacttttagtgcaaatgaatatgatacaaatggtgtgtacaatgatcaaatcggctatatcacaaaaacagtggcattcatcccatatacagatcaagtgtggatggatatcagtgaaacagaaggtgtattatatatagagggtgtcaaattggttgtagacgtagaa

SEQ ID NO: 127 - DNA, 3432 bp, Bacilllus thuringiensis
atggatcaacaaaatgaatatgagatcatacaagcgggagtaagcaacgcaattactgatacgttccaaagatatccgctagcaaacaatccaaacacatcatttcaaaatatgaattataaagactatttgaatgaccctatgttcttaggtgaaacgagagatgcacaaactgccattacgacttctttagagataataagtgaaattcttggatttttaggggtaccatttgtagggcctattattggctttacgaatcgactcatcaatttattatggccaagaaatactacggatatatggaatgcatttatggatgaagtacaagcgcttataaatgagagtattaccaaggcagtacgaagtaaagcaatatcagaattggagggaatacaccaagtctataggttgtatattgaggcacttaacgaatggaaagataccccagataacccattcgtacaagaacgggtaagaacaacattccgtgatgtgaattctattattaattatgcaatgccttcatttagagtgcaaggatttgaaataccattattagtagtttacgcacaagcagcaaatttgcatttagtccttttaagggatgcaactctatttggagcgggatggggatttacagaaacaaatattaatgatcgttacaatgaacaagtacgggtaaccaatggttatatagatcattgtacaaagtggtacaatgaagggctaactcgtttaaagaataattggtcaaaataccatcaattccgtagagaaatgacactcatggtgttagatcttatagcgttatttcctagccatgatgcacgtagatatcctatggaaacatctgcgcaattgacaagagatgtgtatacagatccaattggatatcggggaaatgcaaatttttcagatccgtggactaaccatgtttcattttcaaaggcggaaagtgaaacaattcgaccaccacatttgtttgatacactggagtcagtagaaataaatacagcaaaagccatgctacctctcaatgataaatcgtatatgtattactgggcaggacacacggtaactagtaggctattagattcttctggaaatccattaaaatacacttatggatcgatgacttctgaaaaaaatctagttagcttacctggaaaagacgtatatagaatcaattcagttgcctcaggtttttctaattattatgcaaaattatatggcgtatcaaaagtagatttttctatagtggatagaaataattcaaataaaacgacgtattcttattctaagtcaagtacggtgccatccgacaataaggagaatagagatagtgaaaatgaactccctcaaacaacaacagatcaaccagactacaaaggatacagtcatagattatctcatatcacttttataagttctgcaattccaacttatgtttggacacgtaaaagcgcagatttgactaataccatttatccagataaaattacccaaattccagcggtaaaaatgtatgaattaggaagttcagccgttgtggtaaagggaccgggatttacaggtggagatttagttaagagaacgaataatggtagtcttggacgttttaaaattactatagattccccaggtgctcatagatatcgcttgagagttcgctatcattcagatgttagtggagtatttcatatgcaaattaacaacgtagaaactattcaaggggaatttaaaagtactgtagattcaacaagtactatgtcaaacgactcatttcaacttagagaattcaccaccactttccgatttccgtcaaatgttacagatataaaagtaagtttaggtgctattaatggtcaaggtaatttttatttagacagaattgaatttgctcctgtagatacaaattatgatgaaagaataacattagaaaaagcacagaaagctgtgaatgccttgtttaccgaaggacgaaatgcgctacaaacagatatgacagattataaagtcgatcaggtttcgattctagtggattgtgtatcaggggaagtatatccaaatgaaaaacgagagctactaaatctggtaaaatacgcgaaacgactcagtatagctcgtaatttactggtagatccaaactttacatcgatacatgcatcgatgtattcagaagatgtaaagggatggtacggaagtaatggcattgcgactggaagtggagatgttgttctcaaagagaattatgtaagtttaccaagtaccagtgatgcacaatatccaacctatctctatcaaaaaatagatgaatctaagctcaaagcatatacacgctataaactgagaggatttatcgagaatagtcaagatttagaagcatatgtggttcgctatgatgcaaaacacgaaacattggatgtgtccaataatctattaccagatgttctccctgtcaacgcatgcggagaaccagatcgttgtgcggcactacaatacctggatgaaaatccaaggttggaatgtagttcaatacaagatggtattttatctgattctcactcattttctctcaatatagatacaggttctatggatctcaatgagaatttaggaatttgggtgttgtttaaaatttccacaccagaaggatatgcgaaatttggcaacttagaagtgattgaagatggcacagtaagtggagaagcattagcccgtgtgaaacgccaagaaacgaagtggagaaataagttggcacagctacgaacggaaacacaagcgatttatacacgagcaaaacaagcgctggataatctttttacagatgcacaagactcttacttgaaaataggtgctacatttgcggcaattgtggctgcacgaaagattgttcagtcaatacgtgaagcgtatatgtcatggttatctgtcgtcccaggtgtaaattatcctatttttacagagctgaacgagagagtacagcgagcattccaattatatgatggacgaaatgtcgtgcgtaatggccgattccttaatggagtattggattggattgtgacatcagacgtaagcgtacaagaagaaaatgggaataacgtattggttctatccaattgggatgcgcaagtattacaatgtctgaaactctaccaagaccgcggttatatcttgcgtgtaacggcacgtaaggaaggattgggagaaggatatataacaatcacagatgaagaaggaaatacagatcaattaacatttggttcatgtgaggagatagatacatccaattcttttgtatctacaggctatatgacaaaagaactggaattcttcccagatacagagaaggtgcgtatagaaattgaagaaacagaagggacattcaaggtggaaagtgtagaattattcttgatggaagatctatgt

SEQ ID NO: 128 - DNA, 3504 bp, Bacilllus thuringiensis
atgaaagtgaggctacttatgaataagaattatttaagtaaatcacaggatttaactcaaatatcagagatatttggctatgatcctatccaccctttggtaaatcccaaaaatcatatagaatctttgagagtaaatagaaatgaattacgtacgctaccagaagggtttgcatctagtacagaaagcgcaattactaatactttgaatataattagtatattactagatgcttcaggtcatcctgctgcggctagggtattaggcgttataacaggaataattggaatattatggcctggtggctctcaaaaaacatgggaagagttcatggcagcggtagaagcattaatagacgaaaagattacagagtcatttaaaaatgaagctatttcaaaattaaatggtttagctgacctttacactgtctatttaagtgaattggaattatggctagaacatccgcatgatccatctattatacaatctgttcggacccgatttttagatttagattctgaatttatatcatcaatgcctcaatttgcaataagtggttttgaagtctcatttttacctgtatatgcacaagctgcaaacctccatttattattattaagggatttatcatattatgggaatgattggggcttgcagcagccagaaattgaaaattattacaatagacaaataaataatattcagaaatatacggatcattgtgtgaaatggtaccaattaggattacaagatgtatataataaatacaattcaacgattataaatgaagatggaggacttccgtggacccattataatcgttaccgtagggaaatgacaattttagtgctagatttagttgctactttctcaactaatgattggaaaaaatattacctggaaacaaatgttgaattatcaagagaaatctatacagatccactaggttatgaagacagtgatgaaggaaacattactgatgtggattggtatagtgaaggagtatctttctctacgatcgaaaatttgcattccccaaaacttgttgaatggctaaaaagaatcactattcaaacggactatttttctgcgggctctgatgaaagttactgttgggcgggacattatatatatactacgttcaccgattcagataaagagtatagtcgttactatggtaatcctgaaaatgttgagtccactacctcctatacattcgctccggctgaagtatataaagttgaaagtgttgttggctcagaaagaaatgccacctatgataactatgtaaattcagctaatactttttatcaagttacaccaacaaatgagttaaaaaaattcatttattcttatcgaaatgattacgacaaaaaaactctatactcagatgaccaattacccttagaaacagatcctcctaaatatggagaatattcacataggttatccaatattacctgtgctcctctcaattctgatgattttggattagtacccatattaggttggacgcatacaagtttaaaacgtgaaaatataatttatccagataagattacacaaattccagctgtgaaaagcttttcaacagaaggaacttgggagagggtggcagcaggacctggatttacaggcgggaatgtaacacaagcaacaaatactgtaacaagcggaattaaaacaacagatttagtaaaaatacgagttagaatagatagcactgcatcgtcaaagcaatatcgtgtcagacttcgatatgcttctaatcaagatttttctcatgctcatttctatacgggtactggctcaaatgaaacaacttttagtcttaaaaaaactactgactttccatttgcaaattataattcgtttggttatgtagagattccgcgagtgctaaaatttagctcaggtagtgaaattataaatgtttacgtgtatccagaaaatgggttaaaggttcaagtagacaaaattgaattcatcccagtggatgataattatgaagatagagtaacattagaaaaagcacagaaagcagtgaatactttgtttacagtgggaagaaatgcactccaaacagacgtgacggattataaagtggatcaggtttcgattttagtagattgtgtatcagaagaattatatcccaatgaaaaaaaagaattacaaaatttagtaaaatacgcaaaacgtctcagcatttctcgtaatttactattagaccctaatttcacttccattaatgcaccaaaaattcgtggatggcacggtagtcaaggaatttttgtcggaaatggcaattatatttttaaagggccgtatgttcatttacaaggtacaaatgatgcacaatatccaacctatctctatcaaaagatagatgaatcgaaactcaaagaatatatacgatataaactgagaggttttatcgagagtagtcaagatttagaggtgtatgtaattcgctatgatgtcaaacgggaaacattggatgtatccaataatttatcatcagatgatacacctgcgaatgcctgcggaggaccaaatcgatgcatagaacaacaatatctggatgataacccaacgttagaatgtagttcgatccaggatggcattttatttgattctcattcattttctctcaatatagatacaggctctattgattataatgaaaacgtaggtatttgggttgtatttaaaatttccacactcgaaggatatgcaaaactcggaaacgtagaagtgattgaggatggaccattagttggagaagcgttagcacgtgtgaagcgacaagaaacaaagtggagaaataaattggcacagctacgaacggaaacacaggcgatttatacacgagcaaaacaatcgctggataatctttttatagatgcacaagacgctcacttgaaaataggtactccattcgcggcaattgtagctgcacgagaggctgtacaatcgatacgtgaggtgtatatgccatggttatctgttgttgctggagtaaattatcctattttcacagaattaaatttaagagtacgacgagcacttcaattatatgatttacgaaacgtcgttcgcaatggacgattccgcaatggtctatctaattggaacgtgacatcagatgtagaagtacaagaagaaaatggaaacaatgtattagttctttccaattgggatgcgcaagtattacaatgcataaagctctatcaagaccgtggatatatcttgcgtgtaacggcacgtaaggaaggattgggagaaggctatataacaatcacagatgaagaaggaaatacagatcaattaacatttggttcatgtgaggagatagatgcatccaattctttcgtatctacaggctatatgacaaaagaactggaattcttcccagatacagagaaggtgcgtatagaaattggagaaacagaagggacattcaaggtggaaagtgtagaattattcttgatggaagatctatgt

SEQ ID NO: 129 - DNA, 3492 bp, Bacilllus thuringiensis
atgaattgtataggaggaaaatgtatgactagaaatagacaagatgaatatgaaattattgacgcgtccaattgtggttgtgcgtcagatgatgttaacagatatcctttagcaagtgatccgaatgctgcattacaaaatattaactataaagagtatttacaaatgaccgagggagactatacagattcgaatataagccctagctttattagcggtagagatgtactacaaactggaattgatatagtagggagaatattaggatttataggggttccatttgttggccaaatagttggtttctatactttccttttaaatcagttgtggccaacgaatgataatgcagtatgggaagcttttatggctcaaatagaagagcttattaatcaaagaatatccgaagcagtagtagggcttgcagccgataatctaacgggattacacaataattacgatctatacgtagaagcattggaggagtggctggaaagaccaaacggggcaagagcttctctagttttccaaagatttaacgttttagatggcttatttacacaatttatgccaagctttggtactggacctggaagccgaaactacgcggttccattactgaacgtatatacacaagccgcaaacctccatttgctattattaaaggatgctgaaatatatggggaaagatggggactgaatcaaacgcagattaactcattccatacgcgtcaacaaaatctgactcgagattatacaaaccattgcgtaactacgtataatagtggattagatcgtttaagaggcacaaatgctactagctgggcaaattatcatcaataccgtagagagatgacattgatggtattggatttagtcacgctattcccatattataatgtacgacaatacccaatcgggatacatcctcagcttacacgtgatatatatacagaacccgttctatacaatcgaccagctggtcagaacctttgccatccatggcttacagcgaatactaatattactttttccgaactcgagaatgcatttattcgcccaccccacttgtttgatagaccagagaacatagtaattagtaggaaaagacatcaatcaccatttaacgccgaacattatagtgatctttggtcagggcataggatccaaagtcgttacgtgaatgattcgagcttacatgaatatagttatggtgaaaataccaatttaattacaacaataaacccatcatctagggcaattaatcgcgttgattcgtcaataataaatcttcgtaatccttttgcgggtgtttcaggagttatgcaggcttctttcttgccgaatgggggaggatttaccagtgttgtcaacccacctaattctgggtgtagggacacatatgatacaatagatgatttaccagtatccactaaccaggaggataatcatacactatcacatattactttttacgactttatgatttcgggtaggctcgatagaatactagccccaatgtatgtttggacacgtcaagatgtggaccttactaatacaattgctgcagatagaattacacaaataccattggtaaaggcaagttcaatagccggtattactgttgtgaaagggccagggtttacaggaggcgatattatacaaatgtttggtgtcaaccctgtctttcctagcaacgtgtcaacgaatattcgagttcaatctaatcaatcatcaccacaaagatatcatgtgagaatttactatgcttgctctggctcttccgatttaatacttcgtttaggtgcaaataatattaatgctagaatcccttcgactatgagtccaggtgaacctttaacatatcaatcatttaattttagaagttttaatgaccctgttacacttgcccctggttctaatgaatttagcatatttagaacctcgggagctgcaattctttttatagacagaattgagtttattccagttaatccgacgcgagaggcggaagaggatttagaaaacgcgaaaaaagcggtgtcaagcttgtttacacgtacaagagacggattaaaagtaaatgtgacagattaccaagtcgatcaggcggcaaatttagtgtcatgcttaacagatgaacaatatgcacatgataaaaaaatgttattggaagcggtaagggccgcaaaacgtcatagccgagaacgcaatttacttcaagatccagattttaatgccataaatagtacagaagaaaatggctggcgggcaagtaacggtattgttattagtgagggtggtccactttataaaggccgatctctgtatttaccaagcgcaaatgaagggtatccaacatacatctatcaaaaagtagatgcatcgaagttaaagccatatacacgctatagattagatggatttgtggaaagtagtcaagatttagagattgatttagttcatcatcataaggtccatcttgtgaaaaatgtaccagataatttagtatttgatacttatcctgatggttcttgcagtggcattaatcgatgtgaagaacaacaactagtagatgtgcaactagatgcggagaatcatccaatggattgctgtgaagcatcccaaacacatgaattctcttcttatattaatacaggtgatctaaatgcgagtgtagaccagggagtttgggtgatctttaaagttcaaacaacagacggatatgcgacgctaggaaatcttgagttggtagaagcgggaccattatcaggtgaatctctagaacgtgcacaaagagaaaatgcgaaatggaatacagggttagcaagaaagcgtgcagaaacagagagagtctatcaagctgccaaacaatcaattaaccatctatttgtagactatcaagatcaacaattaaatccagacgtagggatggtagagattacggaagctcaaaatcttgtgaattcgattaccgatgtatatagcgatgtcgtcctgcagattcctggcatcaaccaagagatttacacagagttatctaatcgcttacaaaaagcatggtatctgtatacgtctcgaaacgccgtacaaaatggagactttaacaacgcactagatggttggcatgcaacaactgacgcgacagtgcaacagaacggcgatatgtatttcctaaatctttctcattgggatgcacaagtttcccaacaatttagagtacaaccaaattgtaaatatgtattacgtgtaacagcagagaaagtgggaggcggagacggctacgttacaatccgagacggtgctcatcaccaagaaacacttacatttaatgcatgcgattatgatataaatggcacatacatttctgatagtacgtatatcacaaaagaagtcggattctatccagagacagaacacatgtggatagagataagtgaaacagaaggtgccttccatatagacagtatcgaattcattgaaacacaagag

SEQ ID NO: 130 - DNA, 1662 bp, Bacilllus thuringiensis
gtgagtcctatgtttacaagtagtacgaaaaatacgttaaaaatagaaacgacagattatcaaatagatcaagcggccatttcgatagaatgtatgtcagatggacaaaattcacaggaaaaaatgatgttatgggatgaagtaaaacgggcaaaacaactgagtcaatctcgtaatttactctataatggagattttgaagactcatcaaatggttggacaacaagtgatcgtattaccattcaaacgaataatcctatttttaaaggacattatctcaatatgtctggggcaagaaatattgatgggagtatattcccaacctatatctatcaaaaaatagaggaatccaaattaaaaccctatacacgttatcgagtaagagggtttgtgggaagtagtaaagatctgaaattaatggtaacacgttacggaaaagaaattgatgccatgatagatgttccaaatgatttggcctatatgcaaccaagtccttcatgtggagattatcgctgtgaatcatcgtcccagtatgtgagccatgggtatcctacaccaacagatggatatgcttctgataggtatgcatgccagtccgagcgaggtaaaaaacatgtgaagtgtcacgatcgccatccatttgattttcatattgacaccggagaagtaggtacaaatacaaacgtaggtatggatgtcttgtttaaaatttctaatccagacggatacgctacagtagggaatctagaagtgattgaagaaggcccgctaacaagtgaagcattagcatatgtgaaacaaaaggaaaagaaatggaatcaacacatggagaaaaaacgatgggaaacacaacaagcctacgatccagcaaaacaggctgtagatgcattatttacaaatgaacaagagttacactatcatattactttagatcatattcaaaacgctgatcgactgatacaggcgattccctatgtataccatgcttggttaccgaatgctccaggtatgaactatgatggatatcaagggttaaacgcacgtatcatgcaggcgtaccatttatatgatgcacgaaatgtcataacaaatggtgactttacacagggattacagggatggcacgtaacaggaaaggcaacggtacaacagatggatggagcttctgtattagttctatcaaattggagtgcgggggtatctcaaaacttgcatgcccaagatcatcatggatatgtgttacgtgtgattgccaaaaaagaaggacctggaaaagggtatgtaacgatgatggattgtaatggcaatcaggaaacactgaagttcacttcttgtgaagaaggatatatgacaaaaacagtagaagtattcccggaaagtgatcgaatacgaattgaaatgggagaaacagagggtacgttttatgtagatagcatcgagttgatttgtatgaaaggatatgctagcaataataacccgcacacgggtaatatgtatgagcaaaattataatcaaaatacgagcgatgtgtatcaccaagagtatacaaacaactataaccaagactctagtagtatgtataatcaaaattatactaacaatgatgaccagcattccggttgcacatgtaaccaagggcataactctggctgtacatgtaat

SEQ ID NO: 131 - DNA, 2592 bp, Bacilllus thuringiensis
atgcctttgttcgtcgtgtataaaagtgaacacacatgttacagtacatgtgaagtaaaaaaaggaggtttatacatgaatccatatttcaaaaacaatgcgtatgaaatattagatgatggtaatatgaactatcaccccaagtatccacttacacagccgctaggttctgaattacaaaatatacattacaaagattggttagctacgtttccagaaagaaacgattccattcttggggaaaattcatctctacgtgatggaatcattaccagtactaacatcattgcctaccttctttcagtcccattcccagccgctggagctgcggcgggtatcctcggtgcactgcttggttttctttggcctacgaatacacaggctgtatgggaagcttttatggaagcagtcgaagctctcatagatcaaaagatttctgattttgcacgagagcaagccattgcaaggttagaaggaataaataaggcaatcgaactttatcagaacgcgctgagcaatttggaaaagaatccgaataacgctgttctgcgtgaacacgttcgagaacaatttatagctacgaatacgtatattgtcggatcgatgcctttgtttcgtgtcaagggatatgaagtacccatgttaacgatgtttacagaagctgctaatctccatcttcttatcctacgcgatgcggcaaagtttggagcaagctgggatatggatgtaagtaccatagaatcatatcaacagtatctggaaaaggagacggtaaactacacagattattgtgtgggtacgtacaatgtaggtttggaggaagctaaaacattatttgctgacctctgcgatttaaatacctatccatggactcgttataaccagggatggcgagaagaagaaaaaccgaattgtagcttacaacaaataaatagatatgaacaacaattgaatgaacaaattaattcatatagggctgcttttcgttattcgccaggtgaataccagaaattagagaattggaacttatataatgcctttagaaggaacatgactattatggtattagatcttgtgtctctctggcccacatataatccaaaacagtatgtgcttcctgttaaggcggagttgacacgagaaatttataccgatatacgcgggaccacataccaaagtgacgagtctcaaaatacactacctgtcatagaaggacgtatgattccaccacctcgcttatttcagtggctacgtagctttacttttcatttgcagaatgttcatagtgattggactgctggccaaattgccaccggtttgcaacaaacggtacaaacaacgttagggccatctcaagttttaccactaactggtgtgcaagggacatctactacgagttttatcccctatattgatggtattacgaggatagatacacagcagtggtttgaaccaagacggttcaagttttggagtggtggttatatagagaaaaatttcggatcgatagaagaaaaaagtcctttttgggccgagggaccgaaatggagagtttatgagccatcagcaagagcgaatgagattctggaacatcgattatcatggatgacctatgagcctgtaagatcaaatgcaccttttgtttatccacaatataaacagttaggcgctcttgccctaggatggacacatcagagtgtagatccagaaaatagagtggtctcagataaaatcactcaaattccagcggtgaaagcgtactggaatcgaggagccttttcggttgtgaaaggatctggttcgacaggaggagatctagtacaattaagtccttctggcgaagtgtcaattatggtgaaaccatctcgctctggtataggccaatttcgtgttcgcattcgatatgcggctacagcgaacggtagactcaatatcaaaaaatacgttggtagtatacatgcatctcaatcgtatgattataaacaaacgactactagtaatctcacgttttcagcattccaatatttagatgtttacaacttcaatctagcagaaactcaatttgaggtttggctcaccaatgagagtggtggtcctatctttattgacaaaatcgagttcattccaacaacaccaacaccagaaccagaaccccaaaatccaccagtaccagaaggtagatatcaaatggttacagccttaaataatagtagtattgtagacttgaatctatcacaaagatacgttcaaatatatggaaacggtaacgccgagaatcaaaagtggaggtttgtatatgatgccagtaaagacgcctatcaaattataaatgtagcagccggacaggaattagtattatcttggtttcaatatcccgaagagcctgatgctgtgattggtgaaccgaacaataaactgaaccgacagtattggatttttgaggatgcaggaaatgggtatacttatgttagaaatatggcagatctgaacagggtactggatgtaccaaatggtaatactggaaatggaacacctatttacgcatcgtattttagcggtggcacaaatcaaaaattcaaactgaataagtta

SEQ ID NO: 132 - DNA, 1032 bp, Bacilllus thuringiensis
atgttaataggaaatggaaaggtttttccaaacgagagaagattattttatattatgaaaaaaaataacgaaaaatatggaccaaatggaatagttgatcaaaaagaatttattctctttacagaacaatggatatctctacaaacatatgccattacaggaacaagtttacctataaatgaggatgaaatgcgtaaacatattggtttacgacaaaatacaaaatcaccacaatgttttaaaaatttgtatgatattcattaccaaaataaacacctgtgtacctggtggaataatgacttagttccattaatacttaaaaccatccataatatttcctcttacggatttaaatgcgctggaaagggtactactaaaggatattataaagccctacaagctgatttagaaactatttcacttaatcccaattcactaacacaagaaaaagcatttaaagattttaaaaaacgttgtcaactccttcataaagaagcattacaatataagactacggcagaaaatgctgagaaatggttaaatatattttttgaaggcggaaaagacccaaataataatgatgtaattggagttgcagctattcaaacacacttaaaaaaaataaatgctcatcttgataacaaatatcaaaatagtaactcaaaatataaaagattactatcaaatatgaaccaactaaaacaaagtttagttaacgctataacaggaaaacagaatctttctaataaaaaagttaaaaaaatgataattgaaatgtttcataaaattaacacacaaagtgaaaacatactaaaatcaaaaactggaataatgctaatattccggaaaaacagtgagtcttggtctgctataacaaatcacataagtacccttgctagtgcatccgtaaatgagttgcagaaagaatctgataaattatatcttgaacttaagaatagcaccaattcctggctagaaatagctacacaaacaagaaactttgcactaaatctttataatctaaaaaccaca

SEQ ID NO: 133 - protein, 1231 aa, Bacillus thuringiensis
MVMSSVSIGGKKMSQNNQNEYDIIDVSSGNFISNDSVRYPLANNPNHTLQNINYKDYLNMSEGNSVELFGDSQAFNRVATAQTGLAIVGGALGALGVPFAGEIAGLFSFILDLFWPSQETDVWEMIMDQVQGLIDQSITANVRSQAIAKLEGLGRGLEAYQELLVAWLENRNNARTRSLIKQQYVALEQIFTTGLPEFSVQNQEVPLLGVYAQAANLHLLLLRDVSIFGAEWGFEDYEIDVFYNRQMRYTAEYANYCVEWYNKGLDRLKGTDRISWMKYHQFRREMTLLVLDIVALFPNYDARRYPLETEAQLTREVYTDPIVYNPEEFLGGFCNSWTSDNQSDFSQIENAVIRPPHVFDTIASLEINTARGRIALNNTAYIDFWAGHSLTFRYPNDSARHQVQYGTITSEKNSFPFEVTDVVQVNTTAANLANAYQQAYGAPRAVFQLVNRLNGAVGSLTYSKTHTAIQACTQSLNTNSEIPRLPVSPGVTNLSTLYTHRISHITSYNFSNNLAGNRNRYGNFPVFVWTHRSAEIDNKIYANKITQIPAVKALWASSEPYPVVRGPGFTGGDIARLPNNPNIGLRFLLDPEPGVLFNRRFRVRIRFACDSGARVILTDETGINSETIVLNQTMTTENPRKYDDFQYIESRNVYTLTRFPGPWIWRLGAQSADQTRNVYIDRIEFIPLNPALEAENDLETAKKAVNALFTNRKDTLQISVTDYQINQAANLIECVSDEVYPNEKRLLFDAVKEAKRLSTARNLLEDTDFHAINGGNGWTGSTGIEIVEGDLLFKDRSLRLPSAREIERETYPTYIYQKIEESRLKPNTRYSLRGFIGSSQDLEIYVLRHQAYRVIKNVSDNLLPNMRPINACGGVDRCSQQKYVNNSLELNSSLSNGIGAADSHEFSIHMDTGELNYNEDTGIWVVFKITTTDGYATLGNLELVEEGPLSGDTLERVRKQEKQWQDQMARRRAETETRYGAAKQAIDRLFIDYQDQQLSPGTDISDLTAAQNVVQSIPYVYNDMLPEIPGMNYTSVTELTNRLQQAWDLYDQRNSIPNGDFRYGLNDWNAKSGANVQQVNHTSVLVIPNWDSQASQEITVQPNRRYVLRVTARKEGSGDGYVTIRDGAKYTETLTFNTCDYNGSNVYQEQALYTNDVYNTQSANIQGSNSAYHTQASNTDRYNMNGMYNDQTSYVTKTVEFIPHTEQVWIEMSETEGVFYIESVELIVKEN

SEQ ID NO: 134 - protein, 1169 aa, Bacillus thuringiensis
MSPNNQNEYEIIDATPSTSVSNDSTKYPYANEPTNALQNMNYKDYLRMSEGYDNKYFANPEVFAAPGGITTGITIVTKLLGWLGLPFAGETGMALNFILGLLWPTSGNPWAELMILVEELINQKIEEAVRNKALADLANSGRALQSYLNAFEDWQKNPNIFRSKELVRERFANAEHSLRTEMSSFAIRGFEIPLLATYAQAANLHLFLIKDVQIYGKEWGYTQADIDLFYREQVEFTKEYTEHCINIYNDGLNQLKGSNAKQWIAFNRFRREMTLTVLDVVALFSNYDVRMYPIKTTTELTRTIYTDPLGYTKTGSSSTPPWYNYGSSFSYIESVAIPAPSLVKWLSQIEIYSKSAKATPQSADYWAGHTITYHYGGDNGQAVANYGDRTNPVAVDRYNFEQADIYRVSSSVASSTTSGVKLLTTKAIFDGINTKNGLVSYRYEKSSNFFNELKDTITELPVQLSSPPTYGDAEQYSHRLSYVSNAPTEYSSGGHLILGLIPVLGWTHTSLTQTNQIHSDSITQIPAVKVSNLESGTSVVANPGFTGGDLLKRTSTGRMGTLKLTVAGILSREMTIRIRYAATTDFKLQVIYKGILQSSYNSNKTMNKGENLTYGKFKFANFTLPISLLIPSDLSIDVQNLSSGEEVYIDRIEFIPVGATYEAEQDLENAKKAVNALFTNTKDGLRPGVTDYEVNQAANLVECLSDDLYPNEKRLLFDAVREAKRLSEARNLLQDPDFQEINGENGWTASTGIEVIEGDAVFKGRYLHLPGAREIDTETYPTYLYQKVEEGVLKPYTRYRLRGFVGSSQGLEIYTIRHQTNRIVKNVPDDLLPDVPPVNNDGRINRCSEQKYVNSRLEVENRSGEAHEFSIPIDTGEIDYNENAGIWVGFKITDPEGYATLGNLELVEEGPLSGDALERLQREEQQWKIQMTKRREETDRKYMIAKQAVDRLYADYQDQQLNPNVEITDITAAQNVIQSIPYVYNDAFPGLPGMNYTKFTELTDRLQQAWSLYDQRNAIPNGDFRNELSNWNTTAGVNVQQLNGTSVLVIPNWDAQVSQQFTVQPNQRYVLRVTARKEGVGNGYVSIRDGGNQTETLTFSASDYDTNGVYNIQASNTNGYNTNGVYNDQTGYITKTAEFIPHTNQVWIEMSETEGTFYIESVELIVDVE

SEQ ID NO: 135 - protein, 1166 aa, Bacillus thuringiensis
MSPNNQNEYEIKDATPSTSVSSDSARYPFANEPTNALQNMNYKEYLRMSEGHDAAYFSNPEAFVDTKSIQAIINVIGKALGALGVPGAGIIASFYSFIVGQLWPSNSVSLWEQIMEQVEELIDQKITEYARNKALTELKGLGDALDVYQESLEAWLENRNDTRARSVVSKQFIALELDFVGAIPSFAVSNQEVPLLAVYAQAANLHLLLLRDASIFGADWGFSSSEISTYYNRQVRLTSQYSDYCVKWYNTGLDKLKGTNSASWLKYHQFRREMTLMVLDVVALFPNYNTQTYPIETRAQLTRDVYTDPAAFNNVSDYGFCNPWSTHSGILFSEVENAVIRSPHLFDILSSIEINTARGGIALNNTAYINYWSGHSLKYHETNNPTIRAVNYGRITSEKNSLVLEDREIFETISVVANLANVYQKAYGVPESYFNMTRRGTSSTSYYFYSKTHTTPYGCSDVYPSYSDIPIDRNVPVAESYSHRLSHITFHSFSKNSNAIYGSFPVFVWTHVSADLTNTIYPDAITQLPMVKANALLSGTSVIKGPGSTGGDILRRTSVGRVGNFKVNVNGPLTQRYLVRIRYASTTDLDFYVYRGGTTVSNYRFNKTMNKGASLTYDIFKFASFSTPFTFTKTQDELGISIQNFSSGEEVYIDRIEVIPVGTTYEAETDLEIAKRAVNTLFTNTKDGLRPGVTDYEVNQAANLVECLSDDLYPNEKRLLFDAVKEAKRLSGVRNLLQDSDFQEINGENGWTGSTGSTGIEIVEGDALFKGRYLRLPGAPEIDTETYPTYLYQKIDEGLLKPYTRYRLRGFVGSSQGLEIYTIRHQTNRIVKNVPDDLLPDVSLVSAGDGINRCSEQKYVNSRLEGERGLPNGNRSADAHEFSIQIDTGEIDLNGNEGIWVGFKVATPDGYATLGNLELVEEGPLSGDALERVQREEQQWKIRMTKRREETDRKYTAAKQAVDRLYADYQDQQLNPNVEITDITAAQNLIQSIPYVYNDVFPGLPGMNYAKYTELTNRLQQAWSLYEQRNVIPNGDFRNELNNWNTTSGVNVQQINDRSVLVIPNWDEQVSQQFTVQPNQRYVLRVTARKEGVGNGYVSIRDGGNQTETLTFSANEYDTNGVYNDQIGYITKTVAFIPYTDQVWMDISETEGVLYIEGVKLVVDVE

SEQ ID NO: 136 - protein, 1144 aa, Bacillus thuringiensis
MDQQNEYEIIQAGVSNAITDTFQRYPLANNPNTSFQNMNYKDYLNDPMFLGETRDAQTAITTSLEIISEILGFLGVPFVGPIIGFTNRLINLLWPRNTTDIWNAFMDEVQALINESITKAVRSKAISELEGIHQVYRLYIEALNEWKDTPDNPFVQERVRTTFRDVNSIINYAMPSFRVQGFEIPLLVVYAQAANLHLVLLRDATLFGAGWGFTETNINDRYNEQVRVTNGYIDHCTKWYNEGLTRLKNNWSKYHQFRREMTLMVLDLIALFPSHDARRYPMETSAQLTRDVYTDPIGYRGNANFSDPWTNHVSFSKAESETIRPPHLFDTLESVEINTAKAMLPLNDKSYMYYWAGHTVTSRLLDSSGNPLKYTYGSMTSEKNLVSLPGKDVYRINSVASGFSNYYAKLYGVSKVDFSIVDRNNSNKTTYSYSKSSTVPSDNKENRDSENELPQTTTDQPDYKGYSHRLSHITFISSAIPTYVWTRKSADLTNTIYPDKITQIPAVKMYELGSSAVVVKGPGFTGGDLVKRTNNGSLGRFKITIDSPGAHRYRLRVRYHSDVSGVFHMQINNVETIQGEFKSTVDSTSTMSNDSFQLREFTTTFRFPSNVTDIKVSLGAINGQGNFYLDRIEFAPVDTNYDERITLEKAQKAVNALFTEGRNALQTDMTDYKVDQVSILVDCVSGEVYPNEKRELLNLVKYAKRLSIARNLLVDPNFTSIHASMYSEDVKGWYGSNGIATGSGDVVLKENYVSLPSTSDAQYPTYLYQKIDESKLKAYTRYKLRGFIENSQDLEAYVVRYDAKHETLDVSNNLLPDVLPVNACGEPDRCAALQYLDENPRLECSSIQDGILSDSHSFSLNIDTGSMDLNENLGIWVLFKISTPEGYAKFGNLEVIEDGTVSGEALARVKRQETKWRNKLAQLRTETQAIYTRAKQALDNLFTDAQDSYLKIGATFAAIVAARKIVQSIREAYMSWLSVVPGVNYPIFTELNERVQRAFQLYDGRNVVRNGRFLNGVLDWIVTSDVSVQEENGNNVLVLSNWDAQVLQCLKLYQDRGYILRVTARKEGLGEGYITITDEEGNTDQLTFGSCEEIDTSNSFVSTGYMTKELEFFPDTEKVRIEIEETEGTFKVESVELFLMEDLC

SEQ ID NO: 137 - protein, 1168 aa, Bacillus thuringiensis
MKVRLLMNKNYLSKSQDLTQISEIFGYDPIHPLVNPKNHIESLRVNRNELRTLPEGFASSTESAITNTLNIISILLDASGHPAAARVLGVITGIIGILWPGGSQKTWEEFMAAVEALIDEKITESFKNEAISKLNGLADLYTVYLSELELWLEHPHDPSIIQSVRTRFLDLDSEFISSMPQFAISGFEVSFLPVYAQAANLHLLLLRDLSYYGNDWGLQQPEIENYYNRQINNIQKYTDHCVKWYQLGLQDVYNKYNSTIINEDGGLPWTHYNRYRREMTILVLDLVATFSTNDWKKYYLETNVELSREIYTDPLGYEDSDEGNITDVDWYSEGVSFSTIENLHSPKLVEWLKRITIQTDYFSAGSDESYCWAGHYIYTTFTDSDKEYSRYYGNPENVESTTSYTFAPAEVYKVESVVGSERNATYDNYVNSANTFYQVTPTNELKKFIYSYRNDYDKKTLYSDDQLPLETDPPKYGEYSHRLSNITCAPLNSDDFGLVPILGWTHTSLKRENIIYPDKITQIPAVKSFSTEGTWERVAAGPGFTGGNVTQATNTVTSGIKTTDLVKIRVRIDSTASSKQYRVRLRYASNQDFSHAHFYTGTGSNETTFSLKKTTDFPFANYNSFGYVEIPRVLKFSSGSEIINVYVYPENGLKVQVDKIEFIPVDDNYEDRVTLEKAQKAVNTLFTVGRNALQTDVTDYKVDQVSILVDCVSEELYPNEKKELQNLVKYAKRLSISRNLLLDPNFTSINAPKIRGWHGSQGIFVGNGNYIFKGPYVHLQGTNDAQYPTYLYQKIDESKLKEYIRYKLRGFIESSQDLEVYVIRYDVKRETLDVSNNLSSDDTPANACGGPNRCIEQQYLDDNPTLECSSIQDGILFDSHSFSLNIDTGSIDYNENVGIWVVFKISTLEGYAKLGNVEVIEDGPLVGEALARVKRQETKWRNKLAQLRTETQAIYTRAKQSLDNLFIDAQDAHLKIGTPFAAIVAAREAVQSIREVYMPWLSVVAGVNYPIFTELNLRVRRALQLYDLRNVVRNGRFRNGLSNWNVTSDVEVQEENGNNVLVLSNWDAQVLQCIKLYQDRGYILRVTARKEGLGEGYITITDEEGNTDQLTFGSCEEIDASNSFVSTGYMTKELEFFPDTEKVRIEIGETEGTFKVESVELFLMEDLC

SEQ ID NO: 138 - protein, 1164 aa, Bacillus thuringiensis
MNCIGGKCMTRNRQDEYEIIDASNCGCASDDVNRYPLASDPNAALQNINYKEYLQMTEGDYTDSNISPSFISGRDVLQTGIDIVGRILGFIGVPFVGQIVGFYTFLLNQLWPTNDNAVWEAFMAQIEELINQRISEAVVGLAADNLTGLHNNYDLYVEALEEWLERPNGARASLVFQRFNVLDGLFTQFMPSFGTGPGSRNYAVPLLNVYTQAANLHLLLLKDAEIYGERWGLNQTQINSFHTRQQNLTRDYTNHCVTTYNSGLDRLRGTNATSWANYHQYRREMTLMVLDLVTLFPYYNVRQYPIGIHPQLTRDIYTEPVLYNRPAGQNLCHPWLTANTNITFSELENAFIRPPHLFDRPENIVISRKRHQSPFNAEHYSDLWSGHRIQSRYVNDSSLHEYSYGENTNLITTINPSSRAINRVDSSIINLRNPFAGVSGVMQASFLPNGGGFTSVVNPPNSGCRDTYDTIDDLPVSTNQEDNHTLSHITFYDFMISGRLDRILAPMYVWTRQDVDLTNTIAADRITQIPLVKASSIAGITVVKGPGFTGGDIIQMFGVNPVFPSNVSTNIRVQSNQSSPQRYHVRIYYACSGSSDLILRLGANNINARIPSTMSPGEPLTYQSFNFRSFNDPVTLAPGSNEFSIFRTSGAAILFIDRIEFIPVNPTREAEEDLENAKKAVSSLFTRTRDGLKVNVTDYQVDQAANLVSCLTDEQYAHDKKMLLEAVRAAKRHSRERNLLQDPDFNAINSTEENGWRASNGIVISEGGPLYKGRSLYLPSANEGYPTYIYQKVDASKLKPYTRYRLDGFVESSQDLEIDLVHHHKVHLVKNVPDNLVFDTYPDGSCSGINRCEEQQLVDVQLDAENHPMDCCEASQTHEFSSYINTGDLNASVDQGVWVIFKVQTTDGYATLGNLELVEAGPLSGESLERAQRENAKWNTGLARKRAETERVYQAAKQSINHLFVDYQDQQLNPDVGMVEITEAQNLVNSITDVYSDVVLQIPGINQEIYTELSNRLQKAWYLYTSRNAVQNGDFNNALDGWHATTDATVQQNGDMYFLNLSHWDAQVSQQFRVQPNCKYVLRVTAEKVGGGDGYVTIRDGAHHQETLTFNACDYDINGTYISDSTYITKEVGFYPETEHMWIEISETEGAFHIDSIEFIETQE

SEQ ID NO: 139 - protein, 554 aa, Bacillus thuringiensis
MSPMFTSSTKNTLKIETTDYQIDQAAISIECMSDGQNSQEKMMLWDEVKRAKQLSQSRNLLYNGDFEDSSNGWTTSDRITIQTNNPIFKGHYLNMSGARNIDGSIFPTYIYQKIEESKLKPYTRYRVRGFVGSSKDLKLMVTRYGKEIDAMIDVPNDLAYMQPSPSCGDYRCESSSQYVSHGYPTPTDGYASDRYACQSERGKKHVKCHDRHPFDFHIDTGEVGTNTNVGMDVLFKISNPDGYATVGNLEVIEEGPLTSEALAYVKQKEKKWNQHMEKKRWETQQAYDPAKQAVDALFTNEQELHYHITLDHIQNADRLIQAIPYVYHAWLPNAPGMNYDGYQGLNARIMQAYHLYDARNVITNGDFTQGLQGWHVTGKATVQQMDGASVLVLSNWSAGVSQNLHAQDHHGYVLRVIAKKEGPGKGYVTMMDCNGNQETLKFTSCEEGYMTKTVEVFPESDRIRIEMGETEGTFYVDSIELICMKGYASNNNPHTGNMYEQNYNQNTSDVYHQEYTNNYNQDSSSMYNQNYTNNDDQHSGCTCNQGHNSGCTCN

SEQ ID NO: 140 - protein, 864 aa, Bacillus thuringiensis
MPLFVVYKSEHTCYSTCEVKKGGLYMNPYFKNNAYEILDDGNMNYHPKYPLTQPLGSELQNIHYKDWLATFPERNDSILGENSSLRDGIITSTNIIAYLLSVPFPAAGAAAGILGALLGFLWPTNTQAVWEAFMEAVEALIDQKISDFAREQAIARLEGINKAIELYQNALSNLEKNPNNAVLREHVREQFIATNTYIVGSMPLFRVKGYEVPMLTMFTEAANLHLLILRDAAKFGASWDMDVSTIESYQQYLEKETVNYTDYCVGTYNVGLEEAKTLFADLCDLNTYPWTRYNQGWREEEKPNCSLQQINRYEQQLNEQINSYRAAFRYSPGEYQKLENWNLYNAFRRNMTIMVLDLVSLWPTYNPKQYVLPVKAELTREIYTDIRGTTYQSDESQNTLPVIEGRMIPPPRLFQWLRSFTFHLQNVHSDWTAGQIATGLQQTVQTTLGPSQVLPLTGVQGTSTTSFIPYIDGITRIDTQQWFEPRRFKFWSGGYIEKNFGSIEEKSPFWAEGPKWRVYEPSARANEILEHRLSWMTYEPVRSNAPFVYPQYKQLGALALGWTHQSVDPENRVVSDKITQIPAVKAYWNRGAFSVVKGSGSTGGDLVQLSPSGEVSIMVKPSRSGIGQFRVRIRYAATANGRLNIKKYVGSIHASQSYDYKQTTTSNLTFSAFQYLDVYNFNLAETQFEVWLTNESGGPIFIDKIEFIPTTPTPEPEPQNPPVPEGRYQMVTALNNSSIVDLNLSQRYVQIYGNGNAENQKWRFVYDASKDAYQIINVAAGQELVLSWFQYPEEPDAVIGEPNNKLNRQYWIFEDAGNGYTYVRNMADLNRVLDVPNGNTGNGTPIYASYFSGGTNQKFKLNKL

SEQ ID NO: 141 - protein, 344 aa, Bacillus thuringiensis
MLIGNGKVFPNERRLFYIMKKNNEKYGPNGIVDQKEFILFTEQWISLQTYAITGTSLPINEDEMRKHIGLRQNTKSPQCFKNLYDIHYQNKHLCTWWNNDLVPLILKTIHNISSYGFKCAGKGTTKGYYKALQADLETISLNPNSLTQEKAFKDFKKRCQLLHKEALQYKTTAENAEKWLNIFFEGGKDPNNNDVIGVAAIQTHLKKINAHLDNKYQNSNSKYKRLLSNMNQLKQSLVNAITGKQNLSNKKVKKMIIEMFHKINTQSENILKSKTGIMLIFRKNSESWSAITNHISTLASASVNELQKESDKLYLELKNSTNSWLEIATQTRNFALNLYNLKTT

SEQ ID NO: 142 - DNA, 4017 bp, Artificial Sequence
  synthetic sequence encoding toxin protein
atggcgctcaccccctactacctctctgatgacaccatcgacacccacaaccccaactggatgaaggacatggatgattatgtgctgctctcacagatctccatccctggaacacatgaaaccatggccaagaatccatggggccatgacatccttcctggcaacaacttcatcggcgtctgccagagcttgagcctctccgcgcagctcaatgctggcatcagatacatcgacatcagatgctactatgaaagcagcaaatcagatgctggcatctccgcgccgagcttctccatccaccatgaagtcatcaatgagaacaaggcgctgggagctgatgttctctccgtggtggtgagcttcctccagaacaacccttcagaaaccatcttgatgaggatcaagcaggagaaaacaaaggagagcgacaccaccttcagcaacaccttccagaaatatgttgatcagtacaagagctacttctgggacagcaacaaccaaacaagcatccccaagctgggagaagttagaggaaagatagtggtgctgtatgacattggagatcacaagtttgggctgccatattcagatccaaggctcttctgcacccaggacaactacagcttctccaccaactggcaccagtacaccaaatgggaggaggtgaaaacccacctcacccaagctgatgagcagtaccagagcaaccaagaagatcctcaaaacaacatcctcaagagcgccatcttcctcaactacctctcaggaagcggcaacctcacctaccccttcttcgtcgcctccggccatgttgatcctggaacaaatggaggaaggctttggacaggcctcaccaccttgacaagcaagcacaaatggccagattttcctcgcctcaatggcttcctcggcctctactcaatctactttgaaggcatcaacaacctctgcggcgacaggctggaggactacagatatgttggcattgttgctgctgattttcctggagctgggctgattgagaagatcatcgagatcaacaagacccatcctcctcagatcctcaaggtggcgccgccggagagcatgaccatctcaaaaacatatcagctctccgacaatgaaggccagaaggtgctctggaacaacaccgacttcaaccaaaatcctcaaggcatcttcatcgagttcaacaacagcggcattgaatcagagctgatgttcctcaaggatggcaccaccgtcagcagcttctccaccaacattgatgtcatcagccacaagatcctcaccttggagttcgacaccatcgtggtgaacctccccaacaacagcaagagcagcagcggcaccatctccgccaccctctactactacaaatcaccatgggcctccaccagcaaaactgacaccatccccatcagcaacagcttcaccttcaacaacaagacagagctctggtacaacaacatcctctcgccggccaaggggctgaggatgacaggaagcatcctctatgagaaccagccaaaatcagatttcttccccctccagatccagctgctgaaggatgagaagctggtggaaaccttggtgccatatgtgctgacgccaagccagcacaaggctgatgagcccatcgacttcatcgtctgctcagatcaagaatttgatcagatgatcgtctggaagctgattgctcttggcttctctgatgacattggagatctcaccctcaactactcaggagagatcagctacatccccatggagtacagcaacaccgtgttcaagaagatccatgagctcaccaccacgcctcaagttctctggaagaacacccttcctggcaagctgggagaatatgtcaccatcaatggcttcagaaacatcatgaacaactggagcttcaaccctgcttcaagcctggaaactggaggcattgccatgaagttcctcaagagcggcaaggagatcatcaccctcaatgacatcctctccatccagaaccccaagagaaatgaaagatattcaaagatctacaatgacaactacatctccctccatgttccagaaggatttgatgagatccaggtggccaccttcatgaatgctgacagcttgctgatgtatgaggagctcaccggcaaggtgttcctcaatgatgaaggagttttctcctcaccaaatccaagcctctacatcaacaaggagtacaacacccccaacaccaccatcctctgggaggcgccgctgaacaaccagaaccagatccagatgggcaaccaagctcacttcttcatcgagaacacgccggagccaacaaagctacagttccagttcatcaagaatgagcagatcatctacagcgtggagaacatcatagaggtggaaggaaacccgccgcagatcaccaatgagatcatcgtcatcccaacaaatgtttcaaatggcttcgacaccatccagttcacccccattgatccaaccttcaatggcctcatcgtcggcagcgtggaggtgctctctccttctcaaaacaccgtcaatgaaacaaagatcgagcacagcttgagcctctcagagaagagcaagagcatcttctacaccagcaaggagctggagcagatcaccgcgctcacccagaagctcttcatctccgtcaaggaggacatccttgctgatgatgtcaccgactaccagatcaaccaggtggcgctgaagattgatggcctctcagcagagaacttcctggtggagaagcagcagctggagaggaagatccagcaggccaagaggctctctcaaagaaggaacctgctgcaatatggaaattttgaatcaacagagccatggatcttcagcagccatgccaccatcctggacagcaatgatctcttcccccagcccttcctcaccctcacctcaaccttgacgccggacaagaacccaacatatgcctaccagcagatccccaagaacaggctgaagccatacacaagatacatcgtccgcggcttcattgccaagagcactgagctggacatcctcctcagctgcgacagcaccatcatcaagcagcagctaaatgttcccaccgccaaggtgcagcagatctccattgaaaatggcaactgctgcgctcaagctggctgcatctatgctgatggcaccgtcaccgacagccactggttcacctacaccatcgacactggaagcctccagcaaaattcagatgttgggctggagctctgcttcaagctgacaacagaaaaaggaaatgctcaaattggaaatgtggagatcattgaagaaaggctgctaacagagaaggagaagcagaagaagcagcagaaggagaagaaatgggtgaagcagaagcagatcaagatgagggagatgaggaagatcctggacatcatgcatgaggacattgcttctctctatgacatgaagatgaacctcaagctggatgtcagccaccaggacatccaaaatgtctacatccctcatgcaaattcattggaaggcgtctacctctccatggtgccagatcaaccagggccatattatgaagaatatcagctgctggcctccttgaagagatatgctcgccgcgtctacaggaacaggaacaagatcagcaatggcaccttccaatatgatctgctggactggaagccaaaaggaaatgttgatgttcagattgagaagaagcattcagtgctccagctgctggacagcggcgccatggtgagccagctggtgcagctgcccattgaaaatgtcaaaggagaagagatcagctacctgctgaggattcatgctcaaggaaatggcaaggtcaccatcctccatggagaagaagtcaccgtgctgcccttcaccaactctgatgagcaagttcagatgattgaatggtatccatcaacaaatgaggtgcagctggagatcagcagcaagagcggcaaggtcatcgtcagcagcatcgagatcctcggcttctgctgcaaggtg

SEQ ID NO: 143 - DNA, 4017 bp, Artificial Sequence
  synthetic sequence encoding toxin protein
atggcgctcaccccctactacctctctgatgacaccatcgacacccacaaccccaactggatgaaggacatggatgattatgtgctgctctcacagatctccatccctggaacacatgaaacaatggccaagaatccatggggccatgacatccttcctggaaacaacttcatcggcgtctgccagagcttgagcctctccgcgcagctcaatgctggcatcagatacatcgacatcagatgctactatgaaagcagcaaatcagatgctggcatctccgcgccgagcttctccatccaccatgaagtcatcaatgagaacaaggctcttggagctgatgttctctccgtggtggtgagcttcctccagaacaacccttcagaaaccatcttgatgaggatcaagcaagaaaaaacaaaggagagcgacaccaccttcagcaacaccttccaaaaatatgttgatcagtacaagagctacttctgggacagcaacaaccaaacaagcatccccaagctgggagaagttagaggaaagatagtggtgctgtatgacattggagatcacaagtttgggctgccatattcagatccaaggctcttctgcacccaggacaactacagcttctccaccaactggcaccagtacaccaaatgggaggaggtgaaaacccacctcacccaagctgatgagcagtaccaaagcaaccaagaagatcctcaaaacaacatcctcaagagcgccatcttcctcaactacctctcaggaagcggcaacctcacctaccccttcttcgtcgcctccggccatgttgatcctggaacaaatggaggaaggctttggacaggcctcaccaccttgacaagcaagcacaaatggccagattttccaaggctcaatggcttcctcggcctctactcaatctactttgaaggcatcaacaacctctgcggcgacaggctggaggactacagatatgttggcattgttgctgctgattttcctggagctgggctgattgagaagatcatcgagatcaacaagacccatcctcctcagatcctcaaggtggcgccgccggagagcatgaccatctcaaaaacatatcagctctccgacaatgaaggccagaaggtgctctggaacaacacagatttcaaccaaaatcctcaaggcatcttcatcgagttcaacaacagcggcattgaatcagagctgatgttcctcaaggatggcaccaccgtcagcagcttctccaccaacattgatgtcatcagccacaagatcctcaccttggagttcgacaccatcgtggtgaacctccccaacaacagcaagagcagcagcggcaccatctccgccaccctctactactacaaatcaccatgggcctccaccagcaaaactgacaccatccccatcagcaacagcttcaccttcaacaacaagacagagctctggtacaacaacatcctctcgccggccaaggggctgaggatgacaggaagcatcctctatgagaaccagccaaaatcagatttcttccctctccagatccagctgctgaaggatgagaagctggtggaaaccttggtgccatatgtgctgacaccaagccagcacaaggctgatgagcccatcgacttcatcgtctgctcagatcaagaatttgatcagatgatcgtctggaagctgattgctcttggcttctctgatgacattggagatctcaccttgaactactcaggagagatcagctacatccccatggagtacagcaacaccgtgttcaagaagatccatgagctcaccaccacgcctcaagttctctggaagaacacccttcctggcaagctgggagaatatgtcaccatcaatggcttcagaaacatcatgaacaactggagcttcaaccctgcttcaagcctggaaactggaggaattgccatgaagttcttgaagagcggcaaggagatcatcaccctcaatgacatcctctccatccagaacccaaaaagaaatgaaagatattcaaagatctacaatgacaactacatctccctccatgttccagaaggatttgatgagatccaggtggccaccttcatgaatgctgacagcttgctgatgtatgaagagctcaccggcaaggtgttcctcaatgatgaaggagttttctcctcaccaaatccttctctctacatcaacaaggagtacaacacccccaacaccaccatcctctgggaggcgccgctgaacaaccagaaccagatccagatgggcaaccaagctcacttcttcatcgagaacacgccggagccaacaaagctacagttccagttcatcaagaatgagcagatcatctacagcgtggagaacatcatagaggtggaaggaaacccgccgcagatcaccaatgagatcatcgtcatcccaacaaatgtttcaaatggcttcgacaccatccagttcacccccattgatccaaccttcaatggcctcatcgtcggcagcgtggaggtgctctctccttctcaaaacaccgtcaatgaaacaaagatcgagcacagcttgagcttgtcagagaagagcaagagcatcttctacaccagcaaggagctggagcagatcaccgcgctcacccagaagctcttcatctccgtcaaggaggacatccttgctgatgatgtcaccgactaccagatcaaccaggtggcgctgaagattgatggcctctcagcagagaacttcttggtggagaagcagcagctggagaggaagatccagcaggccaagaggctctctcaaagaaggaacctgctgcaatatggaaattttgaatcaacagagccatggatcttcagcagccatgccaccatcctggacagcaatgatctcttcccccagcccttcctcaccctcacctcaacattgacgccggacaagaacccaacatatgcctaccagcagatccccaagaacaggctgaagccatacacaagatacatcgtccgcggcttcattgccaagagcactgagctggacatcctcctcagctgcgacagcaccatcatcaagcagcagctaaatgttccaacagccaaggtgcagcagatctccattgaaaatggaaactgctgtgctcaagctggctgcatctatgctgatggcaccgtcaccgacagccactggttcacctacaccatcgacactggaagcctccagcaaaattcagatgttgggctggagctctgcttcaagctgacaacagaaaaaggaaatgctcaaattggaaatgtggagatcattgaagaaaggctgctaacagagaaggagaagcagaagaagcagcagaaggagaagaaatgggtgaagcagaagcagatcaagatgagggagatgaggaagatcctggacatcatgcatgaggacattgcttctctctatgacatgaagatgaacttgaagctggatgtcagccatcaagacatccaaaatgtctacatccctcatgcaaattcattggaaggcgtctacctctccatggtgccagatcaaccagggccatattatgaagaatatcagctgctggcctccttgaagagatatgctcgccgcgtctacaggaacaggaacaagatcagcaatggcaccttccaatatgatctgctggactggaagccaaaaggaaatgttgatgttcaaattgagaagaagcattcagttctccagctgctggacagcggcgccatggtgagccagctggtgcagctgccaattgaaaatgtcaaaggagaagagatcagctacctgctgaggattcatgctcaaggaaatggcaaggtcaccatcctccatggagaagaagtcaccgtgctgcccttcaccaactctgatgaacaagttcagatgattgaatggtatccatcaacaaatgaggtgcagctggagatcagcagcaagagcggcaaggtcatcgtcagcagcatcgagatcctcggcttctgctgcaaggtg

SEQ ID NO: 144 - DNA, 810 bp, Artificial Sequence
  synthetic sequence encoding toxin protein
atgatcaacaaggagttctacctctacctcagcagccagcctcagttcccaactggcagcttcggcatctggggcttcacagattcagcaacaggaagcaccaatgagcagtttgagttccttcctcaagaagaaacaataaacatccccacggcgccgtcgctggagaagctggaccccttccccaagtacaccagcttcaccgacaaccttcctgatgaaactcctcaccgcctcaccggctggaccaagatcccctacttgatcgtcaaggacaatgaagttccttcagagttcaagatcgacatggcgccatattatgtcatcaagaagtaccagtactggaagaagattgaaaccctctccttggcgcctggagaatcaagaagcaccagctacacatatggcaccaccaccaccaccaccaccaacatggagaagaggatcgacatgaccatcaatgaagatggaggcatcaagttcaacctcaccaagatcaacctcggcatcaccggcgacatgaagaaaaccatcaccgacaacctggacatcagagaaagctcaacaacaagggtgatgaacagcaccacagaaacagatgatcaaaggaaccccttcaccaccaagccgctggtgtacagcagatacatcctcaccaccgagctccagtacatcaggccaagccagaacaaatatgatccagacatcctcatcgacagctggaccttcacagatcatcaaacaatgaagatcaccagcttcccttcaagggaggagatctccgccgagctcaacaagctgaagatcaag

SEQ ID NO: 145 - DNA, 810 bp, Artificial Sequence
  synthetic sequence encoding toxin protein
atgatcaacaaggagttctacctctacctcagcagccagcctcagttcccaactggcagcttcggcatctggggcttcacagattcagcaacaggaagcaccaatgagcagtttgagttccttcctcaagaagaaacaataaacatccccacggcgccgtcgctggagaagctggaccccttccccaagtacaccagcttcaccgacaaccttcctgatgaaactcctcaccgcctcactggatggacaaagatcccctacttgatcgtcaaggacaatgaagttccttcagagttcaagatcgacatggcgccatattatgtcatcaagaagtaccagtactggaagaagattgaaaccttgagcttggctcctggagaatcaagaagcaccagctacacatatggcaccaccaccaccaccaccaccaacatggagaagaggatcgacatgaccatcaatgaagatggaggcatcaagttcaacctcaccaagatcaacctcggcatcaccggcgacatgaagaaaaccatcaccgacaacctggacatcagagaaagctcaacaacaagggtgatgaacagcacaacagaaacagatgatcaaaggaaccccttcaccaccaagccgctggtgtacagcagatacatcctcaccaccgagctccagtacatcaggccaagccagaacaaatatgatccagacatcctcatcgacagctggaccttcacagatcatcaaacaatgaagatcaccagcttcccttcaagggaggagatctccgccgagctcaacaagctgaagatcaag

SEQ ID NO: 146 - DNA, 858 bp, Artificial Sequence
  synthetic sequence encoding toxin protein
atgttcgtccacatcctcaccggcaagatcctcacccatccagacatctacctccagagcaaggccatggactacatcggcgacaccacccagctctggacgctggagacagtgaaggacaacaaccacttctactacatcaggaacttctactgcggctcaaatgtggcgctgaagagggacaccgacttcatcatgtggagcatcaccgccacagatgacatcgacatctccgacaccttccccaccttggaaaccttggattcatatcctcagtacaccaacattgatgacaacctcccctccaccacgccggaccgcctcatcagcttcaccctgctgccggcgccgacggtgaaggacaaccagctcaccaccaagcagaaggttcagatcaccccctactacttgatggagaagcaccagtactggaccaagctgcaagatttctcaattgctcctggagcagagctcaccaagcagtacacatatggcatggacaccaaccaggtgaatgagatgacaaaaacaactggcatcaccatcaacacagattttggcgtcaacttctcaccaggaggcatcctggaagcaaatggaagctacaagaagcagatcaccaatgatctgaagctgcatgaaagccaaacaacagatgttgctgaaacaacaacaaaaacatcaaaatttgacaacagcaacaacacctacaccatccactacgccaagtacatcttgacaacaaggctggtgctgaagcagttcaacagcaacaacagcaacatcaccattggagattggagcttctcagatccaaacaccatccaaacaacaagcctcatccctgacatgctgaag

SEQ ID NO: 147 - DNA, 858 bp, Artificial Sequence
  synthetic sequence encoding toxin protein
atgttcgtccacatcctcaccggcaagatcctcacccatccagacatctacctccagagcaaggccatggactacatcggcgacaccacccagctctggacgctggaaacagtgaaggacaacaaccacttctactacatcaggaacttctactgcggctcaaatgtggcgctgaagagggacacagatttcatcatgtggagcatcaccgccacagatgacatcgacatctccgacaccttccccaccttggaaaccttggattcatatcctcagtacaccaacattgatgacaacctcccctccaccacgccggaccgcctcatcagcttcaccctgctgccggcgccgacggtgaaggacaaccagctcaccaccaagcagaaggttcagatcaccccctactacttgatggagaagcaccagtactggaccaagctgcaagatttctcaattgctcctggagcagagctcaccaagcagtacacatatggcatggacaccaaccaggtgaatgagatgacaaaaacaactggcatcaccatcaacacagattttggcgtcaacttctcaccaggaggcatcctggaagcaaatggaagctacaagaagcagatcaccaatgatctgaagctgcatgaaagccaaacaacagatgttgctgaaacaacaacaaaaacatcaaaatttgacaacagcaacaacacctacaccatccactatgccaagtacatcttgacaacaaggctggtgctgaagcagttcaacagcaacaacagcaacatcaccattggagattggagcttctcagatccaaacaccatccaaacaacaagcctcatccctgacatgctgaag

SEQ ID NO: 148 - DNA, 1026 bp, Artificial Sequence
  synthetic sequence encoding toxin protein
atgatcccgctggagcctcaagctgacaccgacaagcagcagttcctcttcttccgcctggatggaggaaagtacctcatcacccacaccttctctggagatgtcatccaaggagttcgaggagggctgctgccgccgcactacaagaaggaatgggtgacagctgacatcttcgtctaccatggaaatgttgatccagagatccgcctctcacctcactggatcatcaagaacaccgacatccccaacacctaccagctgctgaacacccaatggggcctctacctggtgccatatgatcaaggatatggaagcaactacctcggcgccatcatcaaaggaaatgatgatcctcacacctactggaccttccagagcattgccaccctccagcccatcatcaggccaaagctggagaggctacatgccttcccccagtacaagcaggtgaatgagaagctcacctttgaaacagctcaccagctgattggatggacgctgctgccatatgtttttgtcaaggaccaccagctggagaacaagaagaggatcaacctctctccctactacatcctggagaagtaccagtactggaaatgcattgagcacataagcctcggccctggagaaacaaaaacatcaagctacacatatggaacaacaagcatcatccagcagacgctggaagctcatcttggcatcatcatcagccaagatggaggcctcctcttcaagaacaacaggctgacgccgcaccgcggcatcaccttcgacatcaagaagaagatcatgaaggacctccacatccatgaagccatcaccgacatccccatgaaatcaatcaccacagaatatgagcacaagaaccccttccaaacaaagctcttcagctacatgaagtacatcctcgccaccaagttcgtgctgaagagggtgagccaaaatgaacatgatccaaacatcgaggtgaatgaatggaccttcactgatggcaacaccatcaagatcaccagctatcctcccttc

SEQ ID NO: 149 - DNA, 1026 bp, Artificial Sequence
  synthetic sequence encoding toxin protein
atgattcctctggagcctcaagctgacaccgacaagcagcagttcctcttcttccgcctggatggaggaaagtacctcatcacccacaccttctctggagatgtcatccaaggagttcgaggagggctgctgccgccgcactacaagaaggaatgggtgacagctgacatcttcgtctaccatggaaatgttgatccagagatcaggctctcacctcattggatcatcaagaacaccgacatccccaacacctaccagctgctgaacacccaatggggcctctacctggtgccatatgatcaaggatatggaagcaactacctcggcgccatcatcaaaggaaatgatgatcctcacacctactggaccttccagagcattgccaccttgcagcccatcatcaggccaaagctggagaggctacatgccttccctcagtacaagcaggtgaatgagaagctcacctttgaaacagctcatcagctgattggatggacgctgctgccatatgtttttgtcaaggaccaccagctggagaacaagaagaggatcaacctctctccatactacatcctggagaagtaccagtactggaaatgcattgagcacataagcctcggccctggagaaacaaaaacatcaagctacacatatggaacaacaagcatcatccagcagaccttggaagctcatcttggcatcatcatcagccaagatggaggcctcctcttcaagaacaacaggctgacgccgcaccgcggcatcaccttcgacatcaagaagaagatcatgaaggacctccacatccatgaagccatcaccgacatccccatgaaatcaatcaccacagaatatgagcacaagaaccccttccaaacaaagctcttcagctacatgaagtacatcctcgccaccaagtttgtgctgaagagggtgagccaaaatgaacatgatccaaacatcgaggtgaatgaatggaccttcactgatggcaacaccatcaagatcaccagctatcctcccttc

SEQ ID NO: 150 - DNA, 1098 bp, Artificial Sequence
  synthetic sequence encoding toxin protein
atgatcctggacatcctcaagaaaacaaaatatctggacttcctcaagaagatcaagaacatcttcttcaagatcaggaacaacagaggagaggtgatgattggcctcggcaacaatgaaagagtttcatacaagaagaacagcctctgcggcaatgacaactggatcatctacccgctggacaatggaaaatatgtcattgccaacctcctctatggaggagttcttgatgttcagtacagaaatgagaacctcatcgtctacatgaacaagtacatgagcttgccgcagcagcactggagcttggagacagtggacacccacctcgcctactacaagatcaggaacctagatgttgggatgatcatcggcaagcacatctatgatgacaccatctatgccaactacaccgacattgatgatgagaactaccactggacatttgaagaagctggcgtcatccatctaccaatcaagccaaggctggagcaggtggacaccttccctcaatatgccaaccagaacaatgatcttcccatcaagacccagcaccgcctcattggatggaccttgatcccctccatcatggtgcaagaaacagttcctctcatccagccgctgcaagagctaccatactacatcctggagaagtaccagtactggatgaagctctatgacattgctctgctgcccaaggagaagaggaccatcacctacacatatggcatcacagaaacaatgcaaaattcattgacagagcagattggcatcaccatccacaccgacagcggcgtcagcttcctgctggacaggccagggaagatctaccccatcaagaagcagatcatcagagatttgaagatctctgaaagccaaacagagaagaagatgatcgccaagacagaagccatcacctaccagaacccctttgtttcagatttcctctactgcgccaagtacatcctcaccaccgagctcatcctcaagtacatcgtcagaagcaatggaaatccaaatgtggagatcaacaaatgcatctacacagatcctcaaaccatccaaaccaccatctacagcaagagcgagaagattgagatc

SEQ ID NO: 151 - DNA, 1098 bp, Artificial Sequence; identical to SEQ ID NO: 150
  synthetic sequence encoding toxin protein

SEQ ID NO: 152 - DNA, 2031 bp, Artificial Sequence
  synthetic sequence encoding toxin protein
atgaaccagtactatggcaacaatgagatggaggtgctggacctcaagatgggaagaagcatgtatccatatgctcaaaacagcaggagcgagctgcaaagcatggactacaaggaatggctgcacatgtgtgaaagaaatgatggcctctaccctggaacattagcaagcaccaaggacatcatcaccaccagcttggacatcgtcggcaccatcctcggcttcatccccattgttggaggccccatctcagctggcgtcagcatcctctcctccgtcatcggcctcctctggccggagccaacaccagaagaacctcaaattgatcctcaagccatctggattcagttcatggagaaggtggaggtgctgattgatcaagagatcgccaaggaggcctacaatgctgccattggaaggctaactggcctcaagagggcgctcaacctctaccaggtggccttcgagctctgggtgcaagatccaacagatccagagctgaaggaaaccttgaggatcgagttcctcaatgcaagatcagagatggtgagcaccattgaaaccttcagatacaccggccaggagatcaacctcctcaccgtctttgctcaagctgctgatctccacctgctgctgctgagagaaggcatcatgtatggagttcaatggggctttgatgaaaggacggtggagagcttctacagcaacagccaaggagaaggcctcaaggatcttctacctcagtacaccgactactgcacctactggtacaatgaaggcctccagatcacctacaccttgaagccagatctctccgacacagaaagatatccatgggccaccggcaagccagattggaaccagagggtgctggaggagctggaaggatggaacctcttcaatgattggagaagagatgtcaccatcatggcgctggatctggtggcgctatggccaacatatgatcttggctactacaacaacctggaatatggcgtcaccaccgagctgacaaggccggtgtacagcagagcttctggaacaagctggggaagcatcttgacaagagatcaatatgagcaaggcatcgtccgctctcctcatctggtgacatggctcaacagcgtggacttccacctcaaccctggccccttcaatgcttcaaacagctacaagcactacaccggcctcaagatgaagtactactacagcggcctggactacaccatctatgaaagcccgctcatcggcgccaccagctactcaaagaaaaccatcaatgtggaggccaagtacaacaatgacatgttccaagctgatgtgaagcatgatgatgctgtctacaccatggacttcttcaagaacaatggcaacatcgagaagattggatatccaagagatccaaactacagcaccttgtcatggccgccggagacaaacatcagcaactatgatcatcagatgacatggatctccggccccgccgtcaacaacaccatccccgccttcggcattgaatgggtgcacaacagcagctcacccttcaactacattgctgaaagcaccatcgagaaccccatcatcacccagatgcccgccgtcaaggcagaaaccttgaatggaaatgcttctgtcatcaaggggccaggaagcactggaggtgatctggtttctgtttctcctggagcttcagtggtgatccgcctcaccggcaccacccagccagcatatcaagttcgcctcagatatgtttctcaaggagctggccagctctggatgagcagagatttctaccaagatggaggatggggcaacaactatgcaacaccatttgatgttccagcaacaacatcagatgaaagcctcacctacaacagctttgattatgtggtggcgccggggcagatcacctacccaagcagcacagattggaggatgaccttctacaacagcggcaagaccatcatcatcatggacaagatcgagttcatccccatccaagaaaatgttgctgaatatgaagctcagcag

SEQ ID NO: 153 - DNA, 2031 bp, Artificial Sequence
  synthetic sequence encoding toxin protein
atgaaccagtactatggcaacaatgagatggaggtgctggatctgaagatgggaagaagcatgtatccatatgctcaaaacagcaggagcgagctgcaaagcatggactacaaggaatggctgcacatgtgtgaaagaaatgatggcctctatcctggaacattagcaagcaccaaggacatcatcaccaccagcttggacattgttggcaccatcctcggcttcatccccattgttggaggccccatctcagctggcgtcagcatcctctcctccgtcatcggcctcctctggccggagccaacaccagaagaacctcaaattgatcctcaagccatctggattcagttcatggagaaggtggaggtgctgattgatcaagagatcgccaaggaggcctacaatgctgccattggaaggctaactggcctcaagagagctctcaacctctaccaggtggccttcgagctctgggtgcaagatccaacagatccagagctgaaggaaacattgaggattgagttcctcaatgcaagatcagagatggtgagcaccattgaaaccttcagatacaccggccaagagatcaacctcctcaccgtctttgctcaagctgctgatcttcatctgctgctgctgagagaaggcatcatgtatggagttcaatggggctttgatgaaaggacggtggagagcttctacagcaacagccaaggagaaggcctcaaggatcttctacctcagtacaccgactactgcacctactggtacaatgaaggcctccagatcacctacaccttgaagccagatctctccgacacagaaagatatccatgggccaccggcaagccagattggaaccaaagggtgctggaggagctggaaggatggaacctcttcaatgattggagaagagatgtcaccatcatggcgctggatctggtggctctatggccaacatatgatcttggctactacaacaacctggaatatggcgtcaccacagagctgacaaggccggtgtacagcagagcttctggaacaagctggggaagcatcttgacaagagatcaatatgaacaaggcatcgtccgctctcctcatctggtgacatggctcaacagcgtggacttccacctcaaccctggacccttcaatgcttcaaacagctacaagcactacaccggcctcaagatgaagtactactacagcggcctggactacaccatctatgaaagccctctcatcggcgccaccagctattcaaaaaaaaccatcaatgtggaggccaagtacaacaatgacatgttccaagctgatgtgaagcatgatgatgctgtctacaccatggacttcttcaagaacaatggcaacattgagaagattggatatccaagagatccaaactacagcaccttgtcatggccgccagaaacaaacatcagcaactatgatcatcagatgacatggatctccggccctgctgtcaacaacaccatccccgccttcggcattgaatgggtgcacaacagcagctcacccttcaactacattgctgaaagcaccatcgagaaccccatcatcacccagatgcctgctgtcaaggcagaaacattgaatggaaatgcttctgtcatcaaggggccaggaagcactggaggtgatcttgtttctgtttctcctggagcttcagtggtgatcaggctcaccggcaccacccagccagcatatcaagttcgcctcagatatgtttctcaaggagctggccagctctggatgagcagagatttctaccaagatggaggatggggcaacaactatgcaacaccatttgatgttccagcaacaacatcagatgaaagcctcacctacaacagctttgattatgtggtggcgccggggcagatcacctacccaagcagcacagattggaggatgaccttctacaacagcggcaagaccatcatcatcatggacaagattgagttcatccccatccaagaaaatgttgctgaatatgaagctcaacaa

SEQ ID NO: 154 - DNA, 2751 bp, Artificial Sequence
  synthetic sequence encoding toxin protein
atgatcttcgtcatccccaacagagatcagttcttcaagatcaccggcaagcagagcggcaaggtgatgagcgtggatgagcagagcaccagcaacaatgctcacattgatcaatatgattgggtgtaccagaacaaccaaaaatggctcttcatccccctcaacaacaactactacgccatcgtcaatgagaactcagggctggtgatgagcgtcgaccagcagagcaccgccaacaatgctctcattgatcaatatgaatggcatggagatgaaagccagcaatggttcttgaaggatctggagaatggctacaatggcatccaagcaaggcattctggaaaatttgcttcagtggaccagcagagcaccgccaacaatgcctacattgatcaatatccatgggtggaccagaacaaccagatgtggagcttggagacagtggaaagtttcaccctgccggccatcatgacatatcctctggcgccgccgccgcagtacagcagcatgggagaaactcttcctgatcacacagaaagcctaccaacaaactacaccttggcgccgtgcatagctgtggaagatccatactacaacaaccagcagaagatccaaactggaaatgaatactacctctatgtcaggaagcagtactggaagaaggtggccagccacaccttggcgcctggagaaagctatggctacaagcagatctcagggatgacaacaacagatcaaaccaccgtcaccaagaccgtcagccacagctttggagctgatgttggcctcaagttcagaaaagattctgtttctgctgggctgagctaccagtacagcgaggagctctctgttcaagaaagcagatcagaaacagagctctccgtggtggaggaggccttcaccttggagaaccccaacaactaccagatcagctggaccaagtacatcctggtttcagagtacagcgtccaaagagctgatggcaccttggtgaatgagccatggaccgtcaccgactaccacaacacctacagcagcttctacccgctgggcagcgacatcatcgagcagcgcgtcagcgtcggcatcattgatgctcaacaagctgtctacaacctctttgctgatgctcagcattcaaggctgaagatcgacaccaccgactacatgattgatcaaacagccttccaggtggagcagctctcagatgaaacatatgcatatgagaagatgatgctcttcaacctggtgcgctgcgccaagcagctctccgtcaagaggaacctgctgcattatggagattttgaaagccccaactggcagaaccaagaagatggatggcaagcaagcagcaatgtcaccgtgctgagcgacaacccggtgttcaaaggaagatatgccaacatgcccggcgccaagaacacagcttcaacatatctctaccagaaggtggatgaaagcaagctgaagccatacacaagatatctggtgagaggatttgttggaagcagcaaggagctggagctcttcgtcacaagatatggcaaggaggtgcacaggaagatgaacatccccatgaacacctgctcatgctccatgggccaagttgctgactacaccatgagcaatgatccatgccagctctacccttctgggatgaccctcagcagcacagaaggcctctgcgaggacaagcagcattttgtgttccagattgatgttggagagatctaccagcgcgccgacctcggcatcggcgtcggcttcaagatctcctcctcagatggcatggctcagctggacaacatcgaggtgattgaagcaaatcctctcactggagaagctctggcaagggtgaagaagagggagcagaaatggaagagggagctggagcagaagtgcgcgctgacagaaaaaacagtttcttcagcaacacaagctgttgacagcctcttcaccaatgctcagaagaacaggctgaaggccaccaccaccatccaggacatcctcggcgccgaggccaagatcaaggccatcccatatgtctacaacagctactttgaagaagttcctgggatgaactacaccatcttccaagctcttcaaagtgatgtctacaatgcttcaagcctctacaggatcaggaacctcatcagaaatggagatttctcctccggcctctccaactggcatgccaccgccggcgctgatgttcaagaaagagatggcaagagccatgtgctggtgctgagccaatgggatgccaccgtcagccaagaagtttgtgttcagccagaaagaggatatgtgctgcgcgtcacagcaaggaaaggaggatcaggaaaaggatatgtcaccttgacagattgcaccgccgacaacacagaaactgtcaccttcagatctgatgacatggcctccacgccgcggccttctgttcctcaaaggcccatcgagccggccatctgcgacatcccaagatacaatgagagcttcggcattgttccagagatgaacccggtgatgaatgagcagccagaatcatatggaacaacaagctgctcctgcggctgcggcaacaggattcagacgccgtcgacgccaaggatgccaaatgtcactggaagctctcctggctacctcaccaagaccatcgagatgttcccagaaacaaacaggctgaggattgagattggagaaacagaaggaaccttcctggtggagagcatcgagctcatctgcatggaggat

SEQ ID NO: 155 - DNA, 2751 bp, Artificial Sequence
  synthetic sequence encoding toxin protein
atgatcttcgtcatccccaacagagatcagttcttcaagatcaccggcaagcagagcggcaaggtgatgagcgtggatgagcagagcaccagcaacaatgctcacattgatcaatatgattgggtgtaccagaacaaccaaaaatggctcttcatccctctcaacaacaactactatgccatcgtcaatgaaaactcagggctggtgatgagcgtcgaccagcagagcaccgccaacaatgctctcattgatcaatatgaatggcatggagatgaaagccagcaatggttcttgaaggatctggaaaatggctacaatggcatccaagcaaggcattctggaaaatttgcttcagtggaccagcagagcaccgccaacaatgcatacattgatcaatatccatgggtggatcaaaacaaccagatgtggagcttggaaacagtggaaagtttcaccttgccggccatcatgacatatcctctggcgccgccgccgcagtacagcagcatgggagaaactcttcctgatcacacagaaagcctaccaacaaactacaccttggcgccatgcatagctgttgaagatccatactacaacaaccagcagaagatccaaactggaaatgaatactacctctatgtcaggaagcagtactggaagaaggtggcaagccacaccttggctcctggagaaagctatggctacaagcagatctcagggatgacaacaacagatcaaacaactgtcaccaagaccgtcagccacagctttggagctgatgttggcctcaagttcagaaaagattctgtttctgctggcttgagctaccagtacagcgaggagctctctgttcaagaaagcagatcagaaacagagctctccgtggtggaggaggccttcaccttggagaaccccaacaactaccagatcagctggacaaagtacatcctggtttcagagtacagcgtccaaagagctgatggcaccttggtgaatgaaccatggaccgtcaccgactaccacaacacctacagcagcttctatcctcttggcagcgacatcatcgagcagcgcgtcagcgtcggcatcattgatgctcaacaagctgtctacaacctctttgctgatgctcaacattcaaggctgaagatcgacaccaccgactacatgattgatcaaacagccttccaggtggagcagctctcagatgaaacatatgcatatgagaagatgatgctcttcaacctggtgcgctgcgccaagcagctctccgtcaagaggaacctgctgcattatggagattttgaaagccccaactggcaaaatcaagaagatggatggcaagcaagcagcaatgtcaccgtgctgagcgacaaccctgttttcaaaggaagatatgcaaacatgcccggcgccaagaacacagcttcaacatatctctaccagaaggtggatgaaagcaagctgaagccatacacaagatatttggtgagaggatttgttggaagcagcaaggagctggagctcttcgtcacaagatatggcaaggaggtgcacaggaagatgaacatccccatgaacacctgctcatgctccatgggccaagttgctgattacaccatgagcaatgatccatgccagctctatccttctgggatgaccctcagcagcacagaaggcctctgcgaggacaagcagcattttgttttccagattgatgttggagagatctaccagcgcgccgacctcggcatcggcgtcggcttcaagatctcctcctcagatggcatggctcagctggacaacatcgaggtgattgaagcaaatcctctcactggagaagctcttgcaagggtgaagaagagggagcaaaaatggaagagggagctggagcagaagtgcgcgctgacagaaaaaacagtttcttcagcaacacaagctgttgacagcctcttcaccaatgctcagaagaacaggctgaaggccaccaccaccatccaggacatcctcggcgccgaggccaagatcaaggccatcccatatgtctacaacagctactttgaagaagttcctgggatgaactacaccatcttccaagctcttcaaagtgatgtctacaatgcttcaagcctctacaggatcaggaacctcatcagaaatggagatttctcctccggcctctccaactggcatgccaccgccggcgctgatgttcaagaaagagatggaaaaagccatgtgctggtgctgagccaatgggatgccaccgtcagccaagaagtttgtgttcaaccagaaagaggatatgttctccgcgtcacagcaagaaaaggaggatcaggaaaaggatatgtcaccttgacagattgcaccgccgacaacacagaaactgtcaccttcagatctgatgacatggcctccacgccgcggccttctgttcctcaaaggcccatcgagccggccatctgcgacatcccaagatacaatgagagctttggcattgttccagagatgaatccagtgatgaatgagcagccagaatcatatggaacaacaagctgctcctgcggctgcggcaacaggattcagacgccgtcgacgccaaggatgccaaatgtcactggaagctctcctggctacctcaccaagaccatcgagatgtttccagaaacaaacaggctgaggattgagattggagaaacagaaggaaccttcttggtggagagcatcgagctcatctgcatggaagat

SEQ ID NO: 156 - DNA, 1977 bp, Artificial Sequence
  synthetic sequence encoding toxin protein
atgaaccagaactacaacaacaatgaatatgagatcagggacaccgacaccatgtgctaccagagcagatatcctctggcaaatgctcctggaagcgagctccagcagatgaactacaaggactggatggacagctgcaccttggaggagcaggtggagctcttcagagacacctcaaccaccgtccgtgatgctctcaccaccaccgccggcatcattgctgctctcctctccgtcagcaaccctgtttctgctgctgctgctggcatcattgctctgctgattcctcagctctggccttctggatctgatgaagtcacctgggagaagttcatggctgcttcagagatcctcatccagaagcagatcacagaagctgtgaggaacaaggcgctctcagagctggaagggatgtacaggaccatcaggctctacgagctggctgctgaagattggaacaggaacaagaatgatccagaagcaaaggagaggatcaggacccagttccgcgccaccaacaccgtcatcgagttcgccatgccggccttcagagttgctggcttcgaggtgccgctgctaaatgtttatgctcaagctgccaacctccagctcaccctgctgagagatgctgtcaagtttggatatgattggggccttcctcaagatgaggtggatgacatctacagcgagcagctcatcccaaggatctccgagcacacagatcactgcgtccgctacttcaacatcggcgtggaggaggccaagaagctaaaggccaacctggatgattatgcaagatatccatgggcgcagtacatcaaccatggcaagatccaaggcatcgagaactggaacctcttcaatgactacaggaggaacatgaccatcctggtgctggatgtggtggcgctctggccaacatatgatccaaaaagatacagcatcgtcaccaaatcagagctgacaagggagctctacacctccgtccgcggcgccttctatggaagcaccggcgactacaaccaagatctggaggagattgaaaggaacatcatctcgccgccggggctggtgctctggcccatcgagagcatcgtctacacccagaaccacacctactaccccatggccggcctccaaacaagaagctactacagcaacagctacacctaccaagattcaccagtgatcggcgtcactggaacaccaaacaggatcaacttcgacagagctgatcccttcatcctcaccgtcaccatcatcggcttcggccagctgggcaccagcttgggcatctacaccatggattttgtgaaggtgtcaggaagccacaggaaggtgggcaacatcgaggtgggaacagatggctacatcgacatccctgacaggattcctgttggagacaaccctccaaacaccttgagctggatgagcgccggcgccaccaccttgggcatcaccaccttcctccaatatgttggatatgcatggatgcatccttctgttgatttctcaaacaggatctccttggacaagatcactcagatccccgccgtcaaaggaaggagcttgacaggcaccgccaaggtcatcaaggggccaggaagcactggaggagatctggtggcgctctctgcatatgatctgctctccattgctgtttctcttccagcaaatgacaccgtgttctacaagctgaggatcagatatgcttcaagccagtttgcaagagttcagatgagcttcactgggccgctggaggatggagaagcaacatttgattttccagcaacatactcaggaggaaacttgacctacaacagcttcgagtacatcaccaccttcgccatcaacagccagagcgaggagcagtttgtggagatccagttcgtcaacttcaatgaggtggacttcatcatcgacaagctggagttcatccccattgaaggaagcctggaggagaatgaagcagatcaa

SEQ ID NO: 157 - DNA, 1977 bp, Artificial Sequence
  synthetic sequence encoding toxin protein
atgaaccagaactacaacaacaatgaatatgagatcagggacaccgacaccatgtgctaccaaagcagatatcctcttgcaaatgctcctggatcagagctccagcagatgaactacaaggattggatggacagctgcaccttggaggagcaggtggagctcttcagagacacatcaaccaccgtccgtgatgctctcaccaccaccgccggcatcattgctgctcttctctccgtcagcaatcctgtttctgctgctgctgctggcatcattgctctgctgattcctcagctctggccttctggatctgatgaagtgacatgggagaagttcatggctgcttcagagatcctcatccagaagcagatcacagaagctgtgaggaacaaggctctctcagagctggaaggaatgtacagaaccatcaggctctatgagcttgctgctgaagattggaacaggaacaagaatgatccagaagcaaaggagaggatcagaacacagttccgcgccaccaacaccgtcatcgagttcgccatgccggccttcagagttgctggatttgaggtgccgctgctaaatgtttatgctcaagctgcaaacctccagctcaccttgctgagagatgctgtcaagtttggatatgattggggccttcctcaagatgaagttgatgacatctacagcgagcagctcatcccaaggatctcagagcacacagatcactgcgtcagatacttcaacatcggcgtggaggaggccaagaagctaaaggccaacctggatgattatgcaagatatccatgggctcagtacatcaaccatggaaagatccaaggcattgagaactggaacctcttcaatgattacagaagaaacatgaccatcttggtgctggatgtggtggcgctctggccaacatatgatccaaaaagatattccatcgtcaccaaatcagagctgacaagggagctctacacctccgtccgcggcgccttctatggaagcactggagactacaaccaagatctggaggagattgaaagaaacatcatctcgccgccagggctggtgctctggcccattgaaagcatcgtctacacccaaaaccacacctactaccccatggctggcctccaaacaagaagctactacagcaacagctacacctaccaagattcaccagtgatcggcgtcactggaacaccaaacaggatcaacttcgacagagctgatcccttcatcctcaccgtcaccatcattggctttggccagctgggcaccagcttgggcatctacaccatggattttgtgaaggtgtcaggaagccacaggaaggtgggcaacattgaggttggaacagatggctacatcgacatccctgacaggattcctgttggagacaatcctccaaacaccttgagctggatgagcgccggcgccaccaccttgggcatcaccaccttcctccaatatgttggatatgcatggatgcatccttctgttgatttctcaaacaggatctccttggacaagatcactcagatccctgctgtcaaaggaaggagcttgacaggaacagccaaggtcatcaaaggaccaggaagcactggaggagatctggtggcgctctctgcatatgatcttctctccattgctgtttctcttccagcaaatgacaccgtgttctacaagctgaggatcagatatgcttcaagccaatttgcaagagttcagatgagcttcactgggccgctggaagatggagaagcaacatttgattttccagcaacatactcaggaggaaatttgacctacaacagcttcgagtacatcaccaccttcgccatcaacagccaaagcgaggagcagtttgtggagatccagtttgtcaacttcaatgaggtggacttcatcatcgacaagctggagttcatccccattgaaggaagcctggaagaaaatgaagcagatcaa

SEQ ID NO: 158 - DNA, 1062 bp, Artificial Sequence
  synthetic sequence encoding toxin protein
atgatggtgaagagggacatctctccaagagatcttggaggaaaagaagattctcccttcctcctctccaaggaagaatggatcaccatccagaagtacactggagatggagcatatgttcctgtcaatgaagcagagatgaggaaggcgctggcgctctctgcttctgatgagatgccagatttcaatgagctctactcagtctacaccaatgtcaagaaccactgccagaactggacagacaacacctacagggaggtgctgggcgtcgccaatgagatcgtcaactacagccgccgcgccaaggtgtactacaagccgctgatcgactacctacctgccatcattgatggagacacagaagctctggagatgttcaagaagatctgcgagaggctggcaagagaagctgctgagttcagagatcatgctggatcattggccaccatgattggcaccttcgccaccgacaccgccaatgattatcagagcttgaaggtggtgaaggacaaatatgatgaaaaatatggagatcattctgatgaggtgaagcagctccgcgcctccgtggagaggctcagagaagatctggaggagtacatggatgaatatgaagattatcaaagccaatcatggctctccctgctgctgggccccatcttcggcttcgtgctgaagggcatcctggacagcaccaagggcaaggcgctgaaggcaaggattgatgccaccaagcagcagattgaagaatcagacaagatcatccaaagaaatgtctacttgatgagcttgctggacaagacagacactggaacagacaagatccaggagcagatggcggcggcgctgcccatcatccagaagatccatggcatctggaacagccttcattcagatctggatgagctctccaagattgtgatggaggacatccatgatgatccagaatttgctgatcttggagtggagctggccatcatgcaatgggaagctgttggcaagcaagctgatgatttcagagtgaatgctgatgttggcttcgtggtggagcagtacaccgcc

SEQ ID NO: 159 - DNA, 1062 bp, Artificial Sequence
  synthetic sequence encoding toxin protein
atgatggtgaagagggacatctctccaagagatcttggaggaaaagaagattctcccttcctcctctccaaggaagaatggatcaccatccagaagtacactggagatggagcatatgttcctgtcaatgaagcagagatgaggaaggcgctggcgctctctgcttctgatgagatgccagatttcaatgagctctattcagtctacaccaatgtcaagaaccactgccagaactggacagacaacacctacagggaggtgctgggcgtcgccaatgagatcgtcaactacagccgccgcgccaaggtgtactacaagccgctgatcgactacctacctgccatcattgatggagacacagaagctctggagatgttcaagaagatctgtgaaaggctggcaagagaagctgctgagttcagagatcatgctggatcattggccaccatgattggcaccttcgccaccgacacagcaaatgattatcagagcttgaaggtggtgaaggacaaatatgatgaaaaatatggagatcattctgatgaggtgaagcagctccgcgcctccgtggagaggctcagagaagatctggaggagtacatggatgaatatgaagattatcaaagccaatcatggctctccttgctgctgggccccatctttggcttcgtgctgaagggcatcctggacagcaccaagggcaaggcgctgaaggcaaggattgatgccaccaagcagcagattgaagaatcagacaagatcatccaaagaaatgtctacttgatgagcttgctggacaagacagacactggaacagacaagatccaggagcagatggcggcggcgctgcccatcatccagaagatccatggcatctggaacagccttcattcagatcttgatgagctctccaagattgtgatggaggacatccatgatgatccagaatttgctgatcttggagtggagctggccatcatgcaatgggaagctgttggcaagcaagctgatgatttcagagtgaatgctgatgttggcttcgtggtggagcagtacaccgcc

SEQ ID NO: 160 - DNA, 2229 bp, Artificial Sequence
  synthetic sequence encoding toxin protein
atgtacctcaatgtggtgagctccgtctaccacaccatgaggagcattgccatcatgctgctcttccagatcctcaaatgcagccactgcaagaacatggccgtcacctgctgcaacctccaagaaaggctcaacctcaacaccttccacatgcataaagcatcaggaagctacctctacagcctccacatccaggacaagaggccgcacatcaggaacatcagaggaggcctctacatgaacttgaatgacaacaagaatgaatttgagatcatggacaatggcaacatggcctaccagccaagatatcctctggcaaatgctcctggatcagagctgcaagcaatgaactacaaggactggatcgacatgtatgaaagaagcaccaatggcaacatgctgctgcaaaacatgggcgccaccctcggcgtcgccctcgccgtcaccgccttcatcctctccgtcagcttccctgttgcttcagctgctgttggcatcgtcagcttgctgatgccaatgtactggccttcttcttctggaaattctcaagatgtttggaagaacttcatggattctgctgaagctctgatggaccagaagatcgcctaccagaagaggcaatcagctgttctccagctccaggtggtgcaaagcaggctgaaggactaccagcaagctgtctgcaacctcaagagagatccaaacaatgagaactacaagagcttggtgagagatgcttttgatgatgctgatgattcattgaaggaggtgatgatcaacttcggcgccgagagcgacgaggtgctgctgctgaacagctatgctcaagctgccaacctccacctgctgctgctgagagatgttgtcaagtttggaagagattgggggatgaaggagctccaggtggagcagtactatgacaaccctccaaacaggccaggaaatcctggcatggtgcagctactggccatctacacagatcactgcacaagatggtatcaagaaggagctcaagttcagtacaacaccttggactggaacaagttcaatgactacaggagggacatgaccatcatggtgctggacattgtttcaatctggccaacatatgatcccttctactatgaatatccagcaaagatccagctcacaaggaaggtgtacacaagggtgtttggagaatatccaaagaacaggattgatgaggtggaatggatggtgccgacgccgcgcctcttcttatggctggacaagctgaccttctacagaagaaatgaggagctgggccaatatgctggcatcacccaaaggttcaagaccaccttcgacagccagagcttggactacacccaagggatgcaaacagatctctttgatgtggtggagatcaacagcggccagatcaacaacaggctctcattgaatggagtttggaaaacaagcaatgtgctgggccagtacagcggcgccgccaccgtccaaaccttctccttctacctgctgcaaagtgaagatccatacaaccccatcacccttggaaatgtctacaacaccataagcaacacaacatatggcctcccctgctccaccaacaccaccggctgcacctcaaatccctgcgagccatgcaacctctccaccagccaagaaagcgtctgcgacatccctggaaggatcacccacaccttggccaccgtcaactgtggaggatggtatgagaacttgagatacttcgcctacagctgggcgcacatctccgtcaccgtcaacaatgtcatcacgccatcaaaaaccatcacccagatccccgccgtcaaggcctacaacaccactggaaatgtcatctccggcacccaaagcactggaggagatctggtggagctgccggccaacagcagcctccagatgatcctcacccatcttcctggtgacaagatctccggctacaggatgaggatcagatatgctgccaagcagcctgtcaccatcctggtgggccattcttcagattttggagagaagctcagcagctttgagctgccagcaacatattctggaggcagcttgacctacaatgcttttggctacaaggaaactctcaccatcctctcccagcaggtggagtacattggcttcgtcggcttcagaagcaccaatgccaccgtcatcatcgacaagatcgagttcatccccattgaaggaagcgtggaagaatatgaagcaaatcaa

SEQ ID NO: 161 - DNA, 2229 bp, Artificial Sequence
  synthetic sequence encoding toxin protein
atgtacctcaatgtggtgagctccgtctaccacaccatgagaagcattgccatcatgctgctcttccagatcctcaaatgcagccactgcaagaacatggccgtcacctgctgcaacctccaagaaaggctcaacctcaacaccttccacatgcataaagcatcaggaagctacctctacagcctccacatccaggacaagaggccgcacatcaggaacatcagaggaggcctctacatgaacttgaatgacaacaagaatgaatttgagatcatggacaatggcaacatggcctaccagccaagatatcctcttgcaaatgctcctggatcagagctgcaagcaatgaactacaaggactggatcgacatgtatgaaagaagcaccaatggcaacatgctgctgcaaaacatgggcgccaccctcggcgtcgccctcgccgtcaccgccttcatcctctccgtcagcttccctgttgcttcagctgctgttggcatcgtcagcttgctgatgccaatgtactggccttcttcttctggaaattctcaagatgtttggaagaacttcatggattctgctgaagctctgatggatcagaagatcgcctaccagaagaggcaatcagctgttcttcagctccaggtggtgcaaagcaggctgaaggactaccagcaagctgtttgcaacctcaagagagatccaaacaatgaaaactacaagagcttggtgagagatgcttttgatgatgctgatgattcattgaaggaggtgatgatcaacttcggcgccgagagcgacgaggtgctgctgctgaacagctatgctcaagctgccaacctccatctgctgctgctgagagatgttgtcaagtttggaagagattgggggatgaaggagctccaggtggagcagtactatgacaatcctccaaacaggccaggaaatcctggcatggtgcagctactggccatctacacagatcattgcacaagatggtatcaagaaggagctcaagttcagtacaacaccttggactggaacaagttcaatgactacagaagagacatgaccatcatggtgctggacattgtttcaatctggccaacatatgatcccttctactatgaatatccagcaaagatccagctcacaaggaaggtgtacacaagggtgtttggagaatatccaaagaacaggattgatgaggtggaatggatggtgccgacgccgcgcctcttcttatggctggacaagctgaccttctacagaagaaatgaagagctgggccaatatgctggcatcacccaaaggttcaagacaaccttcgacagccagagcttggactacacccaaggaatgcaaacagatctctttgatgtggtggagatcaacagcggccagatcaacaacaggctctcattgaatggagtttggaaaacaagcaatgttcttggccagtacagcggcgccgccaccgtccaaaccttctccttctacctgctgcaaagtgaagatccatacaaccccatcacccttggaaatgtctacaacaccataagcaacacaacatatggcctcccctgctccaccaacaccaccggctgcacctcaaatccatgtgagccatgcaacctctccaccagccaagaaagcgtctgcgacatccctggaaggatcacccacaccttggccaccgtcaactgtggaggatggtatgaaaacttgagatattttgcctacagctgggcgcacatctccgtcaccgtcaacaatgtcatcactccatcaaaaaccatcacccagatccctgctgtcaaggcctacaacaccactggaaatgtcatctccggcacccaaagcactggaggagatctggtggagctgccggccaacagcagcctccagatgatcctcacccatcttcctggtgacaagatctctggctacaggatgaggatcagatatgctgccaagcagcctgtcaccatcctggtgggccattcttcagattttggagagaagctcagcagctttgagctgccagcaacatattctggaggcagcttgacatacaatgcttttggctacaaggaaactctcaccatcctctcccagcaggtggagtacattggctttgttggcttcagaagcaccaatgccaccgtcatcatcgacaagattgagttcatccccattgaaggatctgtggaagaatatgaagcaaatcaa

SEQ ID NO: 162 - DNA, 1992 bp, Artificial Sequence
  synthetic sequence encoding toxin protein
atgaacctcaatgacaacaagaatgaatttgagatcatggacaatggcaacatggcctaccagccaagatatcctctggcaaatgctcctggatcagagctgcaagcaatgaactacaaggactggatcgacatgtatgaaagaagcaccaatggcaacatgctgctgcaaaacatgggcgccaccctcggcgtcgccctcgccgtcaccgccttcatcctctccgtcagcttccctgttgcttctgctgctgttggcattgtttcactgctgatgccaatgtactggccaagcagcagcggcaactctcaagatgtttggaagaacttcatggattctgctgaagctctgatggaccagaagatcgcctaccagaagaggcagagcgccgtcctccagctccaggtggtgcaatcaaggctgaaggactaccagcaagctgtctgcaacctcaagagagatccaaacaatgagaactacaagagcttggtgagagatgcttttgatgatgctgatgattctttgaaggaggtgatgatcaactttggagcagaatcagatgaggtgctgctgctgaacagctatgctcaagctgccaacctccacctgctgctgctgagagatgttgtcaagtttggaagagattgggggatgaaggagctacaagtggagcagtactatgacaaccctccaaacaggccaggaaatcctggcatggtgcagctgctggccatctacacagatcactgcacaagatggtatcaagaaggagctcaagttcagtacaacaccttggactggaacaagttcaatgactacaggagggacatgaccatcatggtgctggacattgtttcaatctggccaacatatgatcccttctactatgaatatccagcaaagatccagctcacaaggaaggtgtacacaagggtgtttggagaatatccaaagaacaggattgatgaggtggaatggatggtgccgacgccgcgcctcttcttatggctggacaagctgaccttctacagaagaaatgaggagctgggccaatatgctggcatcacccaaaggttcaagaccaccttcgacagccagagcttggactacacccaagggatgcaaacagatctctttgatgtggtggagatcaactcaggccagatcaacaacaggctctccttgaatggagtttggaaaacaagcaatgtgctgggccagtacagcggcgccgccaccgtccaaaccttctccttctacctgctgcaaagtgaagatccatacaaccccatcacccttggaaatgtctacaacaccatcagcaacacaacatatggcctcccctgctcaacaaacaccaccggctgcaccagcaacccctgcgagccatgcaacttgagcaccagccaagaaagcgtctgcgacatccctggaaggatcacccacaccttggccaccgtcaactgcggcggctggtatgagaacctccgctacttcgcctacagctgggcgcacatctcagtgaccgtcaacaatgtcatcaccccaagcaagaccatcacccagatccccgccgtcaaggcctacaacaccactggaaatgtcatctcaggaacacaaagcactggaggagatctggtggagctgccggccaacagcagcctccagatgatcctcacccatcttcctggtgacaagatctccggctacaggatgaggatcagatatgctgccaagcagcctgtcaccatcctggtgggccattcttcagattttggagagaagctcagcagctttgagctgccagcaacatattctggaggcagcttgacctacaatgcttttggctacaaggaaactctcaccatcctctcccagcaggtggagtacattggcttcgtcggcttcagaagcaccaatgccaccgtcatcatcgacaagatcgagttcatccccattgaaggaagcgtggaagaatatgaagcaaatcaa

SEQ ID NO: 163 - DNA, 1992 bp, Artificial Sequence
  synthetic sequence encoding toxin protein
atgaacctcaatgacaacaagaatgaatttgagatcatggacaatggaaacatggcctaccagccaagatatcctcttgcaaatgctcctggatcagagctgcaagcaatgaactacaaggactggatcgacatgtatgaaagaagcaccaatggaaacatgctgctgcaaaacatgggcgccaccctcggcgtcgccctcgccgtcaccgccttcatcctctccgtcagcttccctgttgcttctgctgctgttggcattgtttcattgctgatgccaatgtactggccaagcagcagcggcaactctcaagatgtttggaagaacttcatggattctgctgaagctctgatggatcagaagatcgcctaccagaagaggcagagcgccgtcctccagctccaggtggtgcaatcaaggctgaaggactaccagcaagctgtttgcaacctcaagagagatccaaacaatgaaaactacaagagcttggtgagagatgcttttgatgatgctgatgattctttgaaggaggtgatgatcaactttggagcagaatcagatgaggtgctgctgctgaacagctatgctcaagctgccaacctccatctgctgctgctgagagatgttgtcaagtttggaagagattgggggatgaaggagctacaagtggagcagtactatgacaatcctccaaacaggccaggaaatcctggcatggtgcagctgctggccatctacacagatcattgcacaagatggtatcaagaaggagctcaagttcagtacaacaccttggactggaacaagttcaatgactacagaagagacatgaccatcatggtgctggacattgtttcaatctggccaacatatgatcccttctactatgaatatccagcaaagatccagctcacaaggaaggtgtacacaagggtgtttggagaatatccaaagaacaggattgatgaggtggaatggatggtgccgacgccgcgcctcttcttatggctggacaagctgaccttctacagaagaaatgaagagctgggccaatatgctggcatcacccaaagattcaagacaaccttcgacagccagagcttggactacacccaaggaatgcaaacagatctctttgatgtggtggagatcaactcaggccagatcaacaacaggctctccttgaatggagtttggaaaacaagcaatgttcttggccagtacagcggcgccgccaccgtccaaaccttctccttctacctgctgcaaagtgaagatccatacaaccccatcacccttggaaatgtctacaacaccatcagcaacacaacatatggcctcccctgctcaacaaacaccaccggctgcaccagcaacccctgcgagccatgcaacttgagcaccagccaagaaagcgtctgcgacatccctggaaggatcacccacaccttggccaccgtcaactgcggcggctggtatgaaaacctccgctacttcgcctacagctgggcgcacatctcagtgaccgtcaacaatgtcatcaccccaagcaagaccatcacccagatccctgctgtcaaggcctacaacaccactggaaatgtcatctcaggaacacaaagcactggaggagatctggtggagctgccggccaacagcagcctccagatgatcctcacccatcttcctggtgacaagatctctggctacaggatgaggatcagatatgctgccaagcagcctgtcaccatcctggtgggccattcttcagattttggagagaagctcagcagctttgagctgccagcaacatattctggaggcagcttgacatacaatgcttttggctacaaggaaactctcaccatcctctcccagcaggtggagtacattggctttgttggcttcagaagcaccaatgccaccgtcatcatcgacaagattgagttcatccccattgaaggatctgtggaagaatatgaagcaaatcaa

SEQ ID NO: 164 - DNA, 2028 bp, Artificial Sequence
  synthetic sequence encoding toxin protein
atgtaccagaactacaactacaactacaaggaatatgagatcctcggcattggaggaagagactaccagccaagatatcctcttgctcaagctccaaatgctgagctccagcagatgtcatacaaggactggatgaacagatgtgctggagtggagagcggcgagctctttgatgctgatgctgtcaagaccatgctgctgattggaactggcatcagctgggccatcctcggcgtcgccttcccgccgctctcagttgctgttggcatcctcaatgtgatgatcagctacctctggccaagccaagcaacagaagatcagttcagctggaagcagatgatgagcgccaccgagcagctcatcaaccaggccatcaaccccatcatcaagagcaaggccattgatgctctccgcgacctccacagcagcttgagggactacaaccaagctctctgcaacctccaaacaaacctggattcaccagatgtggagagatacaaggaggtggtgaggagggagttcaatgatgcaaatgacaaggccaagagcaccatcatcaacctggagagtgatggcttccagatccagttcctcagcagctatgctcaagctgccaacatccacctgctgctgctgaaggatgtcaagcaatatggagagatctgggggctaacagctctggaggtggagcagtacttcgacaaccctccaagcaagcctggaaatccagggatgatccagctgattgagatctacaccgactactgcatcaactggtacaacagaggcctccagcagcaagcagaaacatactactggaatggcttcaatgatttcagaagaacaatgaccatcgtggtgctggacattgttgctctatggccaacatacaaccccatcaactaccccaagccggtgaaggcgcagctgacaaggacggtgtacacgccgaccttcggccagcacattgcaagcagcaaggtgctatttgatgagctggagctctccttggtgacgccgccgcagctcttcaccttcctggatgctgtcaccttctacagaagagatgatgagctcacccaatatgctggcatcatgcaaaccttgagatacacctcaagcctctccctcttccaaaccatccaaggacaaagaacagatctggtggacaacatcaggatctacagcggcgtgctggatgaagtttggaaaacagcttcagttgttggagagctggacaacaccagcagcatgaacatccaaaccttctccttctacctcctctccaacccagaaaatcctgtcaccatcggccatgtctacagcagcaacaccaccgccgccacatatggcttcccctgcgtcgccaccaacatcagctgcattggtgaaccatgcacgccgtgctccatctcacagccgctggagagcatctgcaacatccccaacaaggccagccacctgctggtgagcgtcaccgccaatgttcagaaccacatcaggctggcaagctatggatggaaccacctctcagctgatgccaacaacctgctggatgctgagaagatcacccagatccccgccgtcaagggcgtcaggatgctgagcaatgtttctgtggtgaaggggccaggaagcactggaggagatctggtgaagatgagcaatggagatggagttttctccatctccatcaccagctcagcaacaaatgaaagagtttctggctatgccatcaggctgagatatgcaagcaatgctgacaccaacttccagatcttcatggccaccaagggccagccaatgattgtttcagatcagatcatcccctccaccagcttcgacaacagcttgacatatcaagccttcgactactacaccctctcagaatttgagctcaagacgctgccggaggtgaagcaggacaccttcttcgacttcttcaagagaggagctggagacatcctcatcgacaagatcgagttcatccccattgaaggaagcctggaggagtacaaggccaaccag

SEQ ID NO: 165 - DNA, 2028 bp, Artificial Sequence
  synthetic sequence encoding toxin protein
atgtaccaaaactacaactacaactacaaggaatatgagatcctcggcattggaggaagagattaccagccaagatatcctcttgctcaagctccaaatgctgagctccagcagatgtcatacaaggattggatgaacagatgtgctggagtggagagcggcgagctctttgatgctgatgctgtcaagacaatgctgctgattggaactggcatcagctgggccatcctcggcgtcgccttccctcctctctcagttgctgttggcatcctcaatgtgatgatcagctacctctggccttctcaagcaacagaagatcagttcagctggaagcagatgatgagcgccacagagcagctcatcaaccaagccatcaaccccatcatcaagagcaaggccattgatgctctccgcgacctccacagcagcttgagggactacaaccaagctctctgcaacctccaaacaaatctggattcaccagatgtggaaagatacaaggaggtggtgagaagggagttcaatgatgcaaatgacaaggccaagagcaccatcatcaacctggaaagtgatggcttccagatccagttcctcagcagctatgctcaagctgcaaacatccatctgctgctgctgaaggatgtcaagcaatatggagagatctgggggctaacagctctggaggtggagcagtacttcgacaatcctccaagcaagcctggaaatccagggatgatccagctgattgagatctacacagattactgcatcaactggtacaacagaggcctccagcagcaagcagaaacatactactggaatggcttcaatgatttcagaagaacaatgaccattgtggtgctggacattgttgctctatggccaacatacaaccccatcaactaccccaagcctgtcaaggctcagctgacaaggacggtgtacacgccgaccttcggccagcacattgcttcaagcaaggtgctatttgatgagctggagctctccttggtgacgccgccgcagctcttcaccttcttggatgctgtcaccttctacagaagagatgatgagctgacacaatatgctggcatcatgcaaacattgagatacacatcaagcctctccctcttccaaaccatccaaggacaaagaacagatctggtggacaacatcaggatctacagcggcgtgctggatgaagtttggaaaacagcttcagttgttggagagctggacaacaccagcagcatgaacatccaaaccttctccttctacctcctctccaatccagaaaatcctgtcaccatcggccatgtctacagcagcaacaccaccgccgccacatatggcttcccctgcgtcgccaccaacatcagctgcattggtgaaccatgcacgccatgctccatctcacagccgctggagagcatctgcaacatccccaacaaggcaagccatctgctggtgagcgtcacagcaaatgttcaaaaccacatcaggctggcaagctatggatggaaccatctttcagctgatgcaaacaacctgctggatgctgagaagatcacccagatccctgctgtcaagggcgtcaggatgctgagcaatgtttctgtggtgaaaggacctggaagcactggaggagatctggtgaagatgagcaatggagatggagttttctccatctccatcacctcttcagcaacaaatgaaagagtttctggctatgccatcaggctgagatatgcttcaaatgctgacaccaacttccagatcttcatggccaccaaaggccagccaatgattgtttcagatcagatcatcccttccaccagcttcgacaacagcttgacatatcaagcatttgactactacaccttgtcagaatttgagctcaagacgctgccagaggtgaagcaggacaccttcttcgacttcttcaagagaggagctggagacatcctcatcgacaagattgagttcatccccattgaaggaagcctggaggagtacaaggccaaccaa

SEQ ID NO: 166 - DNA, 840 bp, Artificial Sequence
  synthetic sequence encoding toxin protein
atggaggtcatcaacatggccatcctggacatctgggcggaggtggacaagttcgccaccaactactgcaaaggaagaggcctcacctactcagggaagaaggggccagttcctcaatatcctctcatcatgacaaacttccagagcagccttcctgatgacagggtgctgacgccgccggagcatgtggccaccctgccaaaaacatatgacaacatcaccagcaggcctcaaacaacaaccctctccttctcagaggagctgacagaaagcacctccaccaccaccacagaaggagtttccattggaacagagctctcctccacccaaaccttcaagatcaagtttgtggaggtgggcctcactcaaacagtttcttctgagtacaccaccaccagcagcaagaccttgacaacagagaagaagaggatcgtcacctcagcagagcagatcaccgtgccgccatacacaaggatcaaggccgtgctggtgattgaaaatggcatctatgatctcatcactgatgtcacctgcgacctcaatgggatgatctactttgaagcaacaaatggcaccagcttcctctccaccatctacgaggtgctgaagggcaacaacacaccagatttcaccttctcatttgaagatccagaagatccaacctgccacttcaatggcagcggcaagatcaagggcaacagcggcctcaacagctatgtgagggtggagcagtcgccgctggaaggatattctggccagtacaggcagtacatccttcctggccaagatctcaccaccgacatcatcacctcagagaacttcggcatccccatcttcaac

SEQ ID NO: 167 - DNA, 840 bp, Artificial Sequence
  synthetic sequence encoding toxin protein
atggaggtcatcaacatggccatcctggacatctgggcagaggtggacaagttcgccaccaactactgcaaaggaagaggcctcacctactcaggaaagaaaggaccagttcctcaatatcctctcatcatgacaaacttccaaagctctcttcctgatgacagggtgctgacgccgccggagcatgttgccaccttgccaaaaacatatgacaacatcaccagcaggcctcaaacaacaaccttgagcttctcagaagagctgacagaaagcacctccaccaccacaacagaaggagtttccattggaacagagctctcctccacccaaaccttcaagatcaagtttgtggaggtgggcctcactcaaacagtttcttctgaatacaccaccaccagcagcaagaccttgacaacagagaagaagaggattgtcacctcagcagagcagatcaccgtgccgccatacacaaggatcaaggctgtgctggtgattgaaaatggcatctatgatctcatcactgatgtcacctgcgacctcaatgggatgatctactttgaagcaacaaatggcaccagcttcctctccaccatctatgaggtgctgaagggcaacaacacaccagatttcaccttctcatttgaagatccagaagatccaacatgccacttcaatggaagcggcaagatcaagggcaacagcggcctcaacagctatgtgagggtggagcagtcgccgctggaaggatattctggccagtacaggcagtacatccttcctggacaagatctcaccaccgacatcatcacctcagaaaactttggcatccccatcttcaac

SEQ ID NO: 168 - DNA, 2058 bp, Artificial Sequence
  synthetic sequence encoding toxin protein
atgaaccaatatgagatcctggacaatggagacatgggctaccagagcagatatcctcttgctcaagctcctggaagcgagttccagcagatgaactacaaggactggctcaacagatgtgctgttggagaatcaggagagctctttggtgacagcaatgctctgagagatggcaccgtcacctccgtcaccatcctctccgtcatcctctccgtcagcttccctgttgcttctgctgctgttggcatcattgctgtggtgctgcccttcctctggcctgaacaagctggaactcctggaacatcagaagctcagttcacctgggagcagctgatggatgctgtggaggagctcatcaacaatgccattgcaacagaagcaaaaagagatgccatcgacgcgctggagaacctccaaacatcagtgaatgactactaccgcgccgtctgcaacctcaagacagatccagacatgaacagctacaaggagagggtgaggatcaccttcattgctgtggaccagaaggcaagggacaccatcaacaggctaaatgacaacccgccgacccatgctgttcagttcctgccaagctatgctcaagctgccaacctccacctgctgctgctccgtgatgtggtgcaatatggagaaagctggggcttcaccgccgtggaggtgcagcagtacttcagcaacaccaccggcgtcggcaaccctgggatgctccagcttctagccatctacaccgactactgcgtccgctggtacaacaccggcctcaggcagcaatatgacactggagattggaacaagttcaacaacttcagaagggacatgaccatcatggtgctggacatcgtcagcctctggcaaacatacaaccccaagctctatgctgttccaacaaagagccagctaacaaggacggtgtacacgccgctgctgggcttcacagatccatatggaactggcttcacccccatccaggtgattgaagctgctgtcactgatgttcctcgcctcttcacctggctgagggagctctccatcgacaagaacattgatcccttccctggaaggcccatcgagccatcacaacctggctacttcactggaagaaggattgttttccagaacaccttggattcaaccttgtttgaaggaggctacagaggaaatcctggagagctgagagaaaccctcaccatcccctcgccggagctgggagatgatgtttggaggatcaccaccaaggacaccatcctctccgcgctggaaggaagggacatcaaatcatggagcttctccttgacaaaatctccagatcaaagcctctatggaggaacatacagcaccaacagcgtcctcaccggcctcccctgcaacaactctgtctcagggccatgcaacccctgcaacccttgccgcattgaaagccccaacatgaatgttccctgcaatgacaagaacctctacagccaccgcttcagctacatgggcgccggcaccatctatgtcatcggcaagaactacctcgcctacttcagctatggatggacccatgtttcagctgatgccaacaacttgattgatccagagaagatcacccagatccccgccgtcaaaggaagcagcatctggaatggcgccaccgtcatcaaggggccaggaagcactggaggagatctggtgcagctgcccatcaggacctccatgcatctggaggtgacgctgccggcctttgatgaggacatcgtcgccagctacagcgtcaggatcagatatgcttcaagccaaagcaccaacctcggcgtccagtttgaaggagagatcgagcaaggaagcaggctggtggagctgccagcaacatattctggaggagatctgacctacaacacctttggatatcaatttgctcttggcatcaccagccattcagaaagccaaagaggcaccatcatcctcaaccatgttggaccttctggccccaacatcatcatcgacaagattgaatttgttcctcagaaggtttctgtcacagaatatgaagcaaatcaa

SEQ ID NO: 169 - DNA, 2058 bp, Artificial Sequence
  synthetic sequence encoding toxin protein
atgaaccaatatgagatcttggacaatggagacatgggctaccaaagcagatatcctcttgctcaagctcctggatcagagttccagcagatgaactacaaggattggctcaacagatgtgctgttggagaatcaggagagctctttggtgacagcaatgctctgagagatggaactgtcacctccgtcaccatcctctccgtcatcctctccgtcagcttccctgttgcttctgctgctgttggcatcattgctgtggtgctgcccttcctctggcctgaacaagctggaactcctggaacatcagaagctcagttcacctgggagcagctgatggatgctgtggaggagctcatcaacaatgccattgcaacagaagcaaaaagagatgccatcgacgcgctggagaacctccaaacatcagtgaatgattactaccgcgccgtctgcaacctcaaaacagatccagacatgaacagctacaaggagagggtgaggatcaccttcattgctgttgatcagaaggcaagagacaccatcaacaggctaaatgacaaccctccaacacatgctgttcagttccttccaagctatgctcaagctgcaaacctccatctgctgctgctccgtgatgttgttcaatatggagaaagctggggcttcaccgccgtggaggtgcagcagtacttcagcaacaccaccggcgtcggcaatccaggaatgctccagcttctagccatctacacagattactgcgtcagatggtacaacactggcttgaggcagcaatatgacactggagattggaacaagttcaacaacttcagaagagacatgaccatcatggtgctggacatcgtcagcttgtggcaaacatacaaccccaagctctatgctgttccaacaaaaagccagctaacaaggacggtgtacacgccgctgctgggcttcacagatccatatggaactggcttcacccccatccaggtgattgaagctgctgtcactgatgttccaaggctcttcacctggctgagggagctctccatcgacaagaacattgatcccttccctggaaggcccatcgagccatcacaacctggctacttcactggaagaagaattgttttccagaacaccttggattcaacattgtttgaaggaggatacagaggaaatcctggagagctgagagaaaccctcaccatcccctcgccggagcttggagatgatgtttggaggatcaccaccaaggacaccatcctctccgcgctggaaggaagagacatcaaatcatggagcttctccttgacaaaatctccagatcaaagcctctatggaggaacatattccaccaacagcgtcctcaccggcctcccctgcaacaattctgtctcaggaccatgcaacccctgcaatccatgccgcattgaaagccccaacatgaatgttccatgcaatgacaagaacctctacagccaccgcttcagctacatgggagctggcaccatctatgtcattggaaagaactacctcgcctacttcagctatggatggacacatgtttcagctgatgcaaacaacttgattgatccagagaagatcacccagatccctgctgtcaaaggaagcagcatctggaatggagccaccgtcatcaaaggaccaggaagcactggaggagatctggtgcagctgcccatcagaacaagcatgcatctggaggtgacgctgccagcatttgatgaggacatcgtcgccagctacagcgtcaggatcagatatgcttcttcacaaagcaccaacctcggcgtccagtttgaaggagagattgagcaaggaagcaggctggtggagcttccagcaacatattctggaggagatctgacatacaacacctttggatatcaatttgctcttggcatcaccagccattcagaaagccaaagaggaaccatcatcctcaaccatgttggaccttctggaccaaacatcatcatcgacaagattgaatttgttcctcagaaggtttctgtcacagaatatgaagcaaatcaa

SEQ ID NO: 170 - DNA, 3276 bp, Artificial Sequence
  synthetic sequence encoding toxin protein
atgaacctcaatgaaaatgaaagcatcatcaagaagcatggaaggatcaacaaccaaacagagcatggcctggagaaggtgaggaaggcggtggacagcctcttcactgatgaagaaagaaattcattgaagctcaccgtcaccgactacaatgttgatcagatcgccaacctggtggaatgcatcagcaatgagatcctgccaagagaaaaaaccatcctgctggacaggatcaggctggccaagaggctgagctatgcaagaaatctactgagcaatggcaacttcgagagcccaaatgggccgcgcctcaagggctggaggacaagcagctatgtcaaggtgctcaccgacaaccccatcttcaaaggaagatatctccacatgccaggagcaaggaagtttgagagcggcaatgtttatccttcatatgtctaccagaaggtggatgaaagcaagctgaagccatacacaagatatctggtgcgcggctttgttggaagcagcaagaacctcaagctgctggtgcaaagatatggatcagagatccaggtggagatggatgttccaaatgacatcagatatgacatgctgacaagcaccttcggcggctgggaaggagaaaggcagcagagctaccagatcatccccacccacacctgcacctgcaaggacaagatctcaatcaacaccatggggcagcagatgaacaagagctgcggctgcaagaatcctcatgttttcagctaccacattgacaccggcagcttggacttcacagagaacctggggctatggtttgtgctgaagatcatgagcacagatggagaagcaaacatcaacaacctggagatcatcgaggtggagccgctcaccggcacggcgctggcatatgtcaagaagagggagcaccgctggaatgtcaacatgacccagaagaggctacaagctgatgaagccatccaggtggctcaagaagctgtgaggaacctcttcaccaaccctcaagaaaaccagctcaacctggacagcaccttcctcaacctggtgattgctgctgatctggtggacaggattccatatgtttatgacagcttcctcatcggcgcgctgccaagcatgaacttcgagatcgtccagaagctctcacagctcatcgaccgcgcctggaggctctatgcaaggaggaacttcgtcagaaatggcaccttcaagagctacaccaatgattggcatgtcacagaaggagtggaggtgaagaaaacatacaacacctcagtgctggtgctgagcaactggagccatgaagcaagccagcagctccaggtggcgccaaacagaggctacctcctccgcgtcacagcaaggaaggaagatgctggaagaggaactgtcaccatctcagattctgctgagatcatcgagatgctgaccttcaccagctgtgatgatgaaacagtttcagaagaaggagccttctggggcttcgtcacccaaacacaagagttcttccctgacaccagccaagttcagatcgacattggagaaacagaagggatgtttgaggtggcttcagtggagctgatctgcatggagcagatggacacgccgctctacaacattgcttgccagaaggacatcgacatcccaagcaacagcgtcggctgcgcgcagaagcaggccatcaacttccatgggccgctgctggaccgcctctcaactgatggaagaacatattgggagtacctgacaagatattctccagtgatgtaccaggccatcaacaagagctacagcaatggaaaaacagatctcatcaccaagttcaatgctgatggcaactggaacatggcagatcaatgggagagcataggagaatttcctcaaattccatatgtttatgcttcagttcaagaaacaaaaacccacctcttcctcggctactacttctaccatgcaagagatgaaggcttcttccctgctgaaggccatgaaaatgatctggaagggatgatgattgctgtcaggaaggatggcaactatggagttcctgtggccatggaaaccatctaccattcagatttcctccgctacaggctgaaggacccaaatgtgcagcctggctacagcaagattgagaacacctccgtccgcttctcagaagtcacccatccagaggtgttcatctccgccaatggagatcttcttggagaatttggccattctgtgagcgccttcactggaaatgagagcgtggagaacaatggcatcgtctacaagtttggagaacctccttcagaagaaccaacccagttctctccagaatggcagcacacctacaactatggcatccttcctatagatgagctctgggagaagaagtacagctatgacaacacccccttccagagcttcggcgtgttccccaacactgctcctggaggaactggaaatgcaaatgctccatggaactggagtgatgaagatcaagatggaacattaggaaaaggcatcttcttcacagatccagcatatttgtttgacatcgacttcaatggcctcggcaccttcagccatgaatatgtctacaacccctactggacccacaaggtgatcctcaagagcgtcacccccaaggtgtacaaagatccaagcaacaaccttcctgacatctacatctccatggagcaatatcctctcaaggggatgagatacatctcagaaagagtttggatgaagagcgacgccgcgctgctggtgccgcacaccgtcaagtttggaggagatcaaaaaacagcaaacaccaccttctccgagccaacaaacaccctctacattgctgtcagcaacatcaacccgctgctctggctggaggtgaaggattatgatgcttctgatgctgatgactacatgggctcaattgtgctgccgctggacaccggcaacattgctggaaaagcagatctgaaggaggccatcatcgactacgaggtcatcaccaaccagaacttcccgctggcgccagaaggcgtctacatctacaaggatgtcaacttctccggcccctacaccctgctgaagcacagcgtcgccaacttcaaggacattgggatgaatgacactgtttcaagcatcaagattgttgggccatatgatgtcatcggctacagcgacgccaacttcactggaagatttgctcctctggtgacaacagacaacatcgacagcaccaacatcaagaatgatgagatgagcagcatcaggatcacaaggaag

SEQ ID NO: 171 - DNA, 3276 bp, Artificial Sequence
  synthetic sequence encoding toxin protein
atgaacctcaatgaaaatgaaagcatcatcaagaagcatggaaggatcaacaaccaaacagaacatggcctggagaaggtgaggaaggcggtggacagcctcttcactgatgaagaaagaaattcattgaagctcaccgtcaccgactacaatgttgatcagatcgccaacctggtggaatgcatcagcaatgagatcctgccaagagaaaaaaccatcctgctggacaggatcaggctggccaagaggctgagctatgcaagaaatctactgagcaatggaaacttcgagagcccaaatgggccgcgcctcaagggctggaggacaagcagctatgtcaaggtgctcaccgacaaccccatcttcaaaggaagatatctccacatgccaggagcaaggaagtttgagagcggcaatgtttatccttcatatgtctaccagaaggtggatgaaagcaagctgaagccatacacaagatatctggtgcgcggctttgttggaagcagcaagaacttgaagctgctggtgcaaagatatggatcagagatccaggtggagatggatgttccaaatgacatcagatatgacatgctgacaagcaccttcggcggctgggaaggagaaaggcagcagagctaccagatcatccccacccacacctgcacctgcaaggacaagatctcaatcaacaccatggggcagcagatgaacaagagctgcggctgcaagaatcctcatgttttcagctaccacattgacaccggcagcttggacttcacagagaacctggggctatggtttgtgctgaagatcatgagcacagatggagaagcaaacatcaacaacctggagatcatcgaggtggagccgctcaccggcacggcgctggcatatgtcaagaagagggagcaccgctggaatgtcaacatgacccagaagaggctacaagctgatgaagccatccaggtggctcaagaagctgtgaggaacctcttcaccaaccctcaagaaaaccagctcaacctggacagcaccttcctcaacctggtgattgctgctgatctggtggacaggattccatatgtttatgacagcttcctcatcggcgcgctgccaagcatgaacttcgagatcgtccagaagctctcacagctcatcgaccgcgcctggaggctctatgcaagaaggaacttcgtcagaaatggcaccttcaagagctacaccaatgattggcatgtcacagaaggagtggaggtgaagaaaacatacaacacctcagtgctggtgctgagcaactggagccatgaagcaagccagcagctccaggtggcgccaaacagaggctacctcctccgcgtcacagcaaggaaggaagatgctggaagaggaactgtcaccatctcagattctgctgagatcatcgagatgctgaccttcaccagctgtgatgatgaaacagtttcagaagaaggagccttctggggcttcgtcacccaaacacaagagttcttccctgacaccagccaagttcagatcgacattggagaaacagaaggaatgtttgaggtggcttcagtggagctgatctgcatggagcagatggacacgccgctctacaacattgcttgccagaaggacatcgacatcccaagcaacagcgtcggctgcgcgcagaagcaggccatcaacttccatgggccgctgctggaccgcctctcaactgatggaagaacatattgggagtacctgacaagatattctccagtgatgtaccaggccatcaacaagagctacagcaatggaaaaacagatctcatcaccaagttcaatgctgatggaaactggaacatggcagatcaatgggagagcataggagaatttcctcaaattccatatgtttatgcttcagttcaagaaacaaaaacccacctcttcctcggctactacttctaccatgcaagagatgaaggcttcttccctgctgaaggccatgaaaatgatctggaagggatgatgattgctgtcaggaaggatggaaactatggagttcctgtggccatggaaaccatctaccattcagatttcctccgctacaggctgaaagatccaaatgtgcagcctggctacagcaagattgagaacacctccgtccgcttctcagaagtcacccatccagaggtgttcatctccgccaatggagatcttcttggagaatttggccattctgtgagcgccttcactggaaatgaaagcgtggagaacaatggcatcgtctacaagtttggagaacctccttcagaagaaccaacacagttctctccagaatggcagcacacctacaactatggcatccttcctatagatgagctctgggagaagaagtacagctatgacaacacccccttccagagcttcggcgtgttccccaacactgctcctggaggaactggaaatgcaaatgctccatggaactggagtgatgaagatcaagatggaacattaggaaaaggcatcttcttcacagatccagcatatttgtttgacatcgacttcaatggcctcggcaccttcagccatgaatatgtctacaacccctactggacccacaaggtgatcctcaagagcgtcacccccaaggtgtacaaagatccaagcaacaaccttcctgacatctacatctccatggagcaatatcctctcaaggggatgagatacatctcagaaagagtttggatgaagagcgacgccgcgctgctggtgccgcacaccgtcaagtttggaggagatcaaaaaacagcaaacaccaccttctccgagccaacaaacaccctctacattgctgtcagcaacatcaacccgctgctctggctggaggtgaaggattatgatgcttctgatgctgatgactacatgggctcaattgtgctgccgctggacaccggcaacattgctggaaaagcagatctgaaggaggccatcatcgactatgaagtcatcaccaaccagaacttcccgctggcgccagaaggcgtctacatctacaaggatgtcaacttctccggcccctacaccttgctgaagcacagcgtcgccaacttcaaggacattgggatgaatgacactgtttcaagcatcaagattgttgggccatatgatgtcatcggctacagcgacgccaacttcactggaagatttgctcctctggtgacaacagacaacatcgacagcaccaacatcaagaatgatgagatgagcagcatcaggatcacaaggaag

SEQ ID NO: 172 - DNA, 2628 bp, Artificial Sequence
  synthetic sequence encoding toxin protein
atggccgacagccagttcttcctccccgcctactacaatgttcttgctgatcctcccttcatcagcaacaccaatgtcatcgagagcaacctggatgctgctgctggaccagattgctcagatccaaacaatgctctcaacatgctctgctttgctcaagacatctccaccgcctggaacaaaggaaaagaaagtggaagctatgatctgctggagaaaacaataggaaattcagcaagctgggcctttggaggaagctctccttctcctggaaactaccttgacatggccaagatctccatcggcctcaccggccacatcatcttcctcggcctcaccaccaccgccggccttgctcctggatggattgttgctggtcatgtgacaaagaggatcttggtgcccatctcaaagctgctggccaccaccttctggccaaagaagaatgatccaaacagcgcctccgacaacacctggcacctggtttctgacagggtggaaaccttggtgcagcaggacatcacagcatatgacagcagcagcttgacccagttcattgctggcttccaagctgtgctggatgatcttcatgaagctgttgctgtggccatctgccaaggacaatcaccagacaaccagacggcgctcaactgcaagccatatgctgatgaggtgctgaatgaaaatgtccgcgtcaagttcgccaccgccgaggaaaccttcagatctctgctgccgcagttccagaaatcaggctatgagttcaccgagctgccgcagttctgccaagctgccaccctccacctctccctgctgcacagcgccatcaacatggccgacaactggggcatcccgccggcgctgaagaacaactatgctgctcagctgaggaccttgatccaaacatacacccaatatgtttattcaacatttgagaaccagcggcagaaggtgaaggccagcagctgggacaacaccaaccaaacatggaatggagttccaaagagcggcatcaacagatatctccagttcctccaagtagccatcctggagtgcttggattatgttgctacatggaggttctatgatgtttatgattatcctcttcctgctcaaagcgacttctcaaggatcgtctttggcaccatcgtcggcccttcagaaaatgttcacaagaacccttctgacaagtacaaaggatatgatgatgatcctgtggtgaagtttgttgattttgatctcaacaccggcgccaacaaatcaccgctgacatggccagattttgagaacaagacctacatgcccattgatcttgatcctggaagcaccagcttccacctcactgctcatgatctcaaccacatctatgttgatggcatcgaggtgggctacaactacacagatgtcattgcaaggacatcaaagaaggtgacgccaaaatatgctctccgcgacaccgtcagccccaacaccggcaacttccctcaagatcaatgggcgcagatcaaggccaccagcttgattgacaccagctacaagtactaccccctcaacttcatcaacattggaagcaggcaaacagatcagatggactacagcgaggtgagctggagcatcaatgacaacagcaatgatgatcattcaacagatctggtgttcatcaatgctcccttcaccaacaacaactgctcctaccccaagcccaaggatcttggcagcggctatgatgatggccagccatgccaaagcaacacccacacccttggaacagatgtcatcagggtgctgtacccggtggtggctcaaggaggaaaatcaacaaacaagataggcttccttcctctctacatgcacaccaacctggagccaacaaacatcatcggccagctggaccctgatgctccagaagattcagattcttcttcagagatcaggatgcttcaaacaaggaccatcccggtggagaagggcgtcctctccggcgccgccaccaatgttgttgaaagggtgacaggaagcaacagcgtgctgctgaagaacaagggcagcgtcaaggtgcccatcaccgtccaaactggaggaaaatacttcatcagggttcatgctgccaccaccgccaaggatggcaagctctccttccattttgattcaccaagctacaagccgccggaggacttcaccatcaccttggagaacaccaagcagtacctggatgacaccacctgcaaccccaacaacagctgctacaacaccgtgagcagagattgctccacctgtgatgagaacaccggcaagaacactggaagcacctgctaccacaccgacaccaagacctgctcagctccaagccatcctatgtggattcaaggagtggagaacagggtgtatgctctcttccccaagatgggcattgacaccaacaaccctggaaatcctgccatccctcaaagcaccatcgtggagctgatgccggtgaactacaacatcaccatcaccaacacctcagatgtggacatcatcatcgacaggatcgagttcatgaccatccccaagatggagcaggtgagcacgccgccttctggaaatgaaacagagaagcagattgctgagatccccaccagccaagat

SEQ ID NO: 173 - DNA, 2628 bp, Artificial Sequence
  synthetic sequence encoding toxin protein
atggctgacagccagttcttcctccccgcctactacaatgttcttgctgatcctcccttcatcagcaacaccaatgtcatcgagagcaacctggatgctgctgctggaccagattgctcagatccaaacaatgctctcaacatgctctgctttgctcaagacatctccaccgcctggaacaaaggaaaagaaagtggaagctatgatctgctggagaaaacaataggaaattcagcaagctgggcatttggaggaagctctccttctcctggaaactaccttgacatggccaagatctccatcggcctcaccggccacatcatcttcctcggcctcaccaccaccgccggccttgctcctggatggattgttgctggtcatgtgacaaaaaggatcttggtgcccatctcaaagctgctggccaccaccttctggccaaagaagaatgatccaaacagcgcctccgacaacacatggcatcttgtttctgacagggtggaaacattggtgcagcaggacatcacagcatatgacagcagcagcttgacacagttcattgctggcttccaagctgtgctggatgatcttcatgaagctgttgctgttgccatctgccaaggacaatcaccagacaaccagacggcgctcaactgcaagccatatgctgatgaggtgctgaatgaaaatgtccgcgtcaagttcgccaccgctgaagaaaccttcagatctctgctgccgcagttccaaaaatcaggctatgagttcacagagctgccgcagttctgccaagctgccaccctccacctctccttgctgcacagcgccatcaacatggctgacaactggggcatcccgccggcgctgaagaacaactatgctgctcagctgaggaccttgatccaaacatacacccaatatgtttattcaacatttgagaaccaaaggcagaaggtgaaggcaagcagctgggacaacaccaaccaaacatggaatggagttccaaagagcggcatcaacagatatcttcagttcctccaagtagccatcctggaatgcttggattatgttgctacatggaggttctatgatgtttatgattatcctcttcctgctcaaagcgacttctcaaggattgtttttggcaccatcgtcggcccttcagaaaatgttcacaagaatccttctgacaagtacaaaggatatgatgatgatcctgtggtgaagtttgttgattttgatctcaacaccggcgccaacaaatcacctctgacatggccagattttgagaacaagacatacatgccaattgatcttgatcctggaagcaccagcttccacctcactgctcatgatctcaaccacatctatgttgatggcatcgaggtgggctacaactacacagatgtcattgcaagaacatcaaagaaggtgacaccaaaatatgctctccgcgacaccgtcagccccaacactggaaacttccctcaagatcaatgggcgcagatcaaggccaccagcttgattgacaccagctacaagtactatcctctcaacttcatcaacattggaagcaggcaaacagatcagatggactacagcgaggtgagctggagcatcaatgacaacagcaatgatgatcattcaacagatctggtgttcatcaatgctcccttcaccaacaacaactgctcctaccccaagccaaaagatcttggaagcggctatgatgatggccagccatgccaaagcaacacccacacccttggaacagatgtcatcagggtgctgtatcctgtggtggctcaaggaggaaaatcaacaaacaagataggcttccttcctctctacatgcacaccaacctggagccaacaaacatcatcggccagctggaccctgatgctccagaagattcagattcttcttcagagatcaggatgcttcaaacaagaaccatccctgtggagaagggcgtcctctccggcgccgccaccaatgttgttgaaagggtgacaggaagcaacagcgtgctgctgaagaacaaaggaagcgtcaaggtgcccatcaccgtccaaactggaggaaaatatttcatcagagttcatgctgccaccaccgccaaggatggcaagctctccttccattttgattcaccaagctacaagccgccggaggacttcaccatcaccttggagaacaccaagcagtacctggatgacaccacctgcaaccccaacaacagctgctacaacaccgtgagcagagattgctccacctgtgatgaaaacaccggcaagaacactggaagcacctgctaccacaccgacaccaagacctgctcagctccttctcatcctatgtggattcaaggagtggagaacagggtgtatgctctcttccccaagatgggcattgacaccaacaaccctggaaatcctgccatccctcaaagcaccatcgtggagctgatgccggtgaactacaacatcaccatcaccaacacctcagatgtggacatcatcatcgacaggattgagttcatgaccatccccaagatggagcaggtgagcacgccgccttctggaaatgaaacagagaagcagattgctgagatcccaacaagccaagat

SEQ ID NO: 174 - DNA, 1191 bp, Artificial Sequence
  synthetic sequence encoding toxin protein
atgctcaccaaggagatgtactacatgtacagcatcaagagatacaagaaggtggccatcgtggcgcccatcgtctgcttgctgggcaccggcctgaccttcgtcaccaagccgacgccggccgccgccgccgtcaccaccaactacgccaccgccaacagcatgtcagatttccagcccatcagcaagtacacccttgctggagatctctatgaaagatatcaaaggatgatcatcgagcatccagatctggtgacatcaagcggcgtcaagccgctcaccaagcagagcgacatcaagtaccaagaagaagcatttgctgggctggcgcaggagatcagagatcacaagctggacaggacgctggaggacaaccctgaatggctgaagctcttcggcatggaccccttcttcaactgggtgccggagtacaccaacctctcaaatcaaaatgagatcaagctggacaacccaagggtggacaactacaaggaggacaacatcgagctggccacctacaccaacaccaccagcagcgagcagaccttcctcaccccaagcaagacagagaaggtgacagacagcttcacctacagcaactctgaaggaggaaagctgggagcttcagccaccaccaccatcagagctggcatccccattgctcaagctcaagaaaccctcaccatgagctttgaagcaacatacaaccacaccagcagcaacaccagcagcacagaaaaaacagtgacatatccttctcagagcttgaagtgccttcctggctacaagacaagcctcatcgtcaagctctcccaagcaaacttctcaggcaccatgagcttcgaggtggagccaacagtggaccagctcatggatgccatcgagaagaactggaagtacaagaatgagaagtacaaggagaaaggagactacaccatccccaacaggaaggagttcctctacaacctctacaagtacagcaacctccccatcccttcatatgtgaagctggatgacaaggagaaaactgtcagcttcggcaagatcaccagcaagtacaccggcgtcgccggccacctctcagaagcatcagcaacagaggtgaagctggagccgctcaacaaggccaagaagcccatcatcatgccgctgaagcagtaccagcagaagattgagaaccatgacagcttc

SEQ ID NO: 175 - DNA, 1191 bp, Artificial Sequence
  synthetic sequence encoding toxin protein
atgctcaccaaggagatgtactacatgtacagcatcaagagatacaagaaggtggccattgtggcgcccatcgtctgcttgctgggaactggcttgaccttcgtcaccaagccgacgccggccgccgccgccgtcaccaccaactatgccaccgccaacagcatgtcagatttccagcccatcagcaagtacacccttgctggagatctttatgaaagatatcaaaggatgatcatcgagcatccagatctggtgacatcaagcggcgtcaagcctctcaccaagcagagcgacatcaagtaccaagaagaagcatttgctgggctggctcaagagatcagagatcacaagctggacaggacgctggaggacaatcctgaatggctgaagctctttggcatggaccccttcttcaactgggttccagaatacaccaacctctcaaatcaaaatgagatcaagctggacaatccaagggtggacaactacaaggaggacaacattgagctggccacctacaccaacaccaccagctcagagcaaaccttcctcacaccaagcaaaacagagaaggtgacagattccttcacctacagcaattctgaaggaggaaagctgggagcttcagcaacaaccaccatcagagctggcatccccattgctcaagctcaagaaaccctcaccatgagctttgaagcaacatacaaccacaccagcagcaacaccagcagcacagaaaaaacagtgacatatccttctcagagcttgaaatgccttcctggatacaaaacaagcctcatcgtcaagctctctcaagcaaacttctcaggaacaatgagcttcgaggtggagccaacagtggatcagctcatggatgccattgagaagaactggaagtacaaaaatgagaagtacaaggagaaaggagattacaccatccccaacaggaaggagttcctctacaacctctacaagtacagcaacctccccatcccttcatatgtgaagctggatgacaaggagaaaactgtcagctttggaaagatcaccagcaagtacaccggcgtcgccggccatctttcagaagcatcagcaacagaggtgaagctggagcctctcaacaaggccaagaagcccatcatcatgccgctgaagcagtaccagcagaagattgaaaaccatgacagcttc

SEQ ID NO: 176 - DNA, 1086 bp, Artificial Sequence
  synthetic sequence encoding toxin protein
atgaagaagaagctgatcgccgccaccgccgtgctcaccctcgccgtcaccggcctggaagctgtcatccccgtcaatgctcttgcttcagatcatgtcaagaactatgtgctgcaagagcacatcgagagcaaggtgtttgatctggagagcttgctgctgaagcacaccaagaatgacatcttcctctcagctctctccacctccaccggcaccgtgctgaacctggacaccttgaaggctgatgtggtgtttggagagcaggaggtgatcgccgacagcttgaagaagaaaacaaacttcaagacagcaaatgttttcatcaatgaagatccagagcctcaagccttcccaacaagggagatctcagaaaatgtttctgacacccacagcaagatgatcacccaaggcttcaaggccggcgcctccgtcaaggctggatttgatcttggcttcaccaaaggagatgtcaccttgaacacagagtacaacaaatcagatcaagaaggaaacaccaccgtcaagagcaagaccatcaagtacccaagccaaaccatcaccgcgccggccaaatctgtggtggtgctggagtacagcttggaggagaacaaggccaaggcctacacagatgtcaatgctgttctagctggagattatgagaagaagtacttcttcatccctgctcacaagttcatcccagatcctcttggcatcggcatcctcaccgacctcattgaaactggagacatcaagccagagaaggagaaaacacaaaggttcaacctctatgatgagctggccaacaatgatctattgaaggatgatgatcctgtcaccttggatgagaagaacaagaaggtgatcctcaatggcaagatcctcacagattcttctgtctacagcgacaggttcatcatcaagaagaaaacatacagcttggaagaatatgagcagctccagaagaatggaaaatcaggaagaagcaagagagatgtcagcagcttggatgcaagcaagaaggacttctccgcgctcacccccattgatgaagaaacatacaccgtggaaggcatcgtcacagagaag

SEQ ID NO: 177 - DNA, 1086 bp, Artificial Sequence; identical to SEQ ID NO: 176
  synthetic sequence encoding toxin protein

SEQ ID NO: 178 - DNA, 2475 bp, Artificial Sequence
  synthetic sequence encoding toxin protein
atggtgatcctcaatgacatctacaaggggccatacaatgtgctggcctcgccgccgctgctggaaacaaacagcatcgacttctccgacctcatccccaagatcatcaagacggtgaaggacacagcagaaactggcaaggtttcagagatcctcaacctcaagaagttcattgatgaaggctatggaaatgacaccaatgtgatggccgccatcttccaaaccatctcaaccttgatcccgctggcctacccgccggcggcggcggtgctgcccatcatcggcgccttcgtcaagctcatcttccccaccaacagcaagagcacctttgatgtgctgaagaacctcattgatgagaagatcgacaagagcatcacctcattggtttctcaaaccctcatcaacaccatcaagaacttccagaacaatgtggagattgtggagaatgccatgaggacggccattggaactggagacaagatcaacaccctcaccaagaacctcaatgagcagagctgctccaccatgtttgatggtcaaacctgcccctgcacgccatcagacaaatgcttggacaaggtgaggacagattttgaaacagccattgccatcatccagctcaatgcttttgaaaatccatttggagaaagcgtcagcaagccagaagatggctacctctatgctcttcctctcttcgccaagagcgtcaccttgaagctctccctccgccacagctacatcaccttcatgaagaagtacagatttgtttcagaagaagtctacaccaaggccgacatccccaaggtgctgattgatcagcagaaggagatcaaggagttcacaagaagaatcctcaccaccttcaacaaccagttcttcaacaagatcaaccccaactacaactcgccggacaagctggagaagtacatcaactacatgaggatcatgcagctggagtgccttgatctggtggcgctatggcccttcttcaacccgctgctgtacccaaatggagcaaactaccagttcaccaggctgatcttccagaacctcgccatccccatgatcagatacaccaacaagccaacagctggccactacaacctccgcggcgtcagtggaagcatccccaacaatgacatcttcagatacacatattctgggatgaggctgacatcagctgccttcatgacctacaagaatggagagaagtacaatgttgatggagagtacctcaccttctccaccaactacagcaacaaggactactacatcaacagcagcaagaatgatcatgacactgttggagaaaacatcttcagctatggcatccccatctccctccgcctgaacagcagcatcaccaatgccaagcagctggcgccagatgatgatcaaacatcattgttcgccaagttcctcaacagcgagaactgggtgtacttcgccggcaagccagagctgacaggaggaagctatggctacaacaacccgccggtgccaaaccacaagatccaaggagtttatcctctggtggacaccaaccaagttggatatgcctacaagagaggatatctacaaaccctcatcagcaatgacatcacgccggagaacatcctccagtacattgaagaaggaaaaaccttcaccttcccgctggacaaggtggagcaggtgaacaacaagctgaggattgaaaatccatatgacagcacccaggtggagtttgcaaatggagcaaatgctctgaagctctcaggaggtcaaaccaccatcttccccatcaagaccatgttccccaacaacaccaccgtcagctgccaggtgaggatcagagctgcaacaaatgctcctggaagcctggatctggacattgacaacaaccaaaccatcaagctgccgctggacaacacctccaccatcaccagcgaccaagttggaagctatggaacaaatggaacagatgattcacttcctctctatgtggtgttcccaaggccgcaggtgaaccagaaggatggagagctgatgccgccaacagaagccatcatcaacctcctcgccggcaagcagtacaacatcaagatcaccaacagcggcagctcagacatcatcctggacaggatcgagttcgtcctcttcaagacccagcagaagccaaatgagataagcctgctgcctcaaaccttcccctgcccaaatgagcagccaaccctctggggaacttctggaggccagcagcaagcaacagggatgaggatcaccccagatggaagggtggacagctcacccatcgtcctctacctcaagggcaagttcgtctggagcttggacccaaggacagagcacctggaggtgcaaaacatcctctttgatcaagtgaagatgggcagcacctgcggcagcggcgcctcgccaagcctcttcaatggaggcatcatcaccttggccagccagagcttcgacaagctggag

SEQ ID NO: 179 - DNA, 2475 bp, Artificial Sequence
  synthetic sequence encoding toxin protein
atggtgatcctcaatgacatctacaaggggccatacaatgtgctggcctcgccgccgctgctggaaacaaacagcatcgacttctcagatctcatccccaagatcatcaagacagtgaaggacacagcagaaactggaaaggtttcagagatcctcaacttgaagaagttcattgatgaaggctatggaaatgacaccaatgtgatggccgccatcttccaaaccatctcaacattgattcctctggcctacccgccggcggcggcggtgctgcccatcatcggcgccttcgtcaagctcatcttccccaccaacagcaagagcacctttgatgtgctgaagaacctcattgatgagaagatcgacaagagcatcacctcattggtttctcaaacattgatcaacaccatcaagaacttccagaacaatgtggagattgtggaaaatgccatgaggacggccattggaactggagacaagatcaacaccctcaccaagaacctcaatgagcagagctgctccaccatgtttgatggtcaaacctgcccctgcacgccatcagacaaatgcttggacaaggtgaggacagattttgaaacagcaattgccatcatccagctcaatgcttttgaaaatccatttggagaaagcgtcagcaagccagaagatggctacctctatgctcttcctctcttcgccaagagcgtcaccttgaagctctccctccgccacagctacatcaccttcatgaagaagtacagatttgtttcagaagaagtttacaccaaggctgacatccccaaggtgctgattgatcagcagaaggagatcaaggagttcacaagaagaatcctcaccaccttcaacaaccagttcttcaacaagatcaaccccaactacaactcgccggacaagctggagaagtacatcaactacatgaggatcatgcagctggaatgccttgatctggtggctctatggcccttcttcaacccgctgctgtatccaaatggagcaaactaccagttcacaaggctgatcttccagaacctcgccatccccatgatcagatacaccaacaagccaacagctggccactacaacctccgcggcgtcagtggaagcatccccaacaatgacatcttcagatacacatattctgggatgaggctgacatcagctgccttcatgacatacaagaatggagagaagtacaatgttgatggagaatacctcaccttctccaccaactacagcaacaaggactactacatcaacagcagcaagaatgatcatgacactgttggagaaaacatcttcagctatggcatccccatctccctccgcctgaacagcagcatcaccaatgccaagcagctggctccagatgatgatcaaacatcattgttcgccaagttcctcaacagcgagaactgggtgtacttcgccggcaagccagagctgacaggaggaagctatggctacaacaacccgccggtgccaaaccacaagatccaaggagtttatcctctggtggacaccaaccaagttggatatgcctacaagagaggatatctacaaacattgatcagcaatgacatcacgccggagaacatcctccagtacattgaagaaggaaaaaccttcaccttccctctggacaaggtggagcaggtgaacaacaagctgaggattgaaaatccatatgacagcacccaggtggagtttgcaaatggagcaaatgctctgaagctctcaggaggtcaaacaaccatcttccccatcaagacaatgttccccaacaacaccaccgtcagctgccaggtgaggatcagagctgcaacaaatgctcctggaagcctggatctggacattgacaacaaccaaaccatcaagctgccgctggacaacacctccaccatcaccagcgaccaagttggaagctatggaacaaatggaacagatgattcacttcctctctatgtggtgttcccaaggccgcaggtgaaccagaaggatggagagctgatgccgccaacagaagccatcatcaacctcctcgccggcaagcagtacaacatcaagatcaccaacagcggcagctcagacatcatcctggacaggattgagttcgtcctcttcaagacccagcagaagccaaatgaaataagccttcttcctcaaaccttcccctgcccaaatgagcagccaaccctctggggaacttctggaggccagcagcaagcaacagggatgaggatcactccagatggaagggtggacagctcacccatcgtcctctacctcaagggcaagtttgtttggagcttggacccaagaacagagcatctggaggtgcaaaacatcctctttgatcaagtgaagatgggaagcacctgcggcagcggcgcctctccaagcctcttcaatggaggcatcatcaccttggcaagccagagcttcgacaagctggaa

SEQ ID NO: 180 - DNA, 2406 bp, Artificial Sequence
  synthetic sequence encoding toxin protein
atgaaccagatctatgtcagcaatgttgctgaaattgaaggcatcaagagggccaaggagaaatatccagacagggagatccccgtctaccagcacaccgtcaccagccagaacctctgcgccaccatcaacccgccgacgctggtgatgaacaccgacatgagaggaacaaacaccttcgagaacaaggacagcttccagaaaacacaaagctcagatctgaggaacatcaacctctctgaatggagagatcttggaggaaatgtcaactctcctcagttcaccaagcagcgcctcatcgacaatggccaaacatcattggacattgatctggagatcggcgtgacctccgccgccggcattgcttgggcgctgctgggcatctctcatcccatcggcagcgccgtcgccggcgtcgtcaatgtcatcctccccatcctctggccaacaacaacagaagatccagatgaagtttggaaatcaatgatgggaaatgctgaagctctggtggacaagaagattgatgaagcaatgaagaacctcgccatcagcaagctcaatggcctcaagaacagcatgaatgaatattgtcaagctctggcaaggctgaaggcagatccaaacaaccccatcgagcaggcttctgtgaggagcgcctaccagagcatggacatgctcttcctctactcaatgccgcagtttgctgttcctcaatttgaggtgcagctgctgccaacatatgctgaagctgccaacctccacctcctcttcatcagagatgctgtcaagtttggaaatgaatgggggatgacacaagctcagatcgacacagagtacaatgatctgaagaggctaacagaagaatacaccaaccactgcgtcaactggttcaacaccggcctccagaggatggaccccttcaagaacccttcaaagaagcctgctgacatgtggaactgcacaacatatccatgggtggcctttgatcaatatgtgagctggtttggaacaacacaaaatcctccaaagaactgcaagagcaccctccaaacaagcatctgcgacaaccaaggaattgaaaatgattcagaagtcacgccgcagctgggaagctacagaggaagcaagagcgagtaccaagggctggagaactggaacctctacaacaacttcagaagggacatgaccatcatggtgctggatgtggtgagcagctggccaacatatgatcccatcaagtacagcatcggcggcatccagagcgagctgacaagagctctctacacccccatcagaggaacaacatacagatcagacagcgcgcagaacaccatctccgccatcgagaacaggatgatccagaagcctcatctcttcacctggctcaacaggatcgagttcaatgagctctgggttggagacaacctctacaccaaaggatatgtgctgattggaggaaagatcatcaggaagttcacctcagaaagcaccgtggaggagagctttggaaaatcagatccttctgcaaggaagatgaatgtggacatcaccccaaatgatcccatcaagaagatcatcaccaggcaatggtttgagccaagggagatcgagctctacaaaggagcaacatatctcttcaccttgggcaccatccaggagccaatgccaaacttcaccggcatcatcacctcaggctgctacccaactggaggagttccaaagccatgcatctatgatccaacaaggaaggagaacatgatgccaaaagctgttgatccaaacacgccaaatgctccaagaagccaatggaaggacagccaccgcctcagctacttcaaatatgagcccatcagaagcaactcaccatatggatatccttctcaaggccagatcggcgccgtggcgctggaatggacccacatgtcagtgaaccccaacaacaccattgctcttgacaagatcactcagatccccgccgtcaagggctgggagctccgcggcggcgccaaggtcatcaaggggccaggaagcactggaggagatctggtgcagctctctggagatttcaatgatctcaccgtccaggtcaccatcccttcttcagaggtgattggaggctacctcatcaggctgagatatgcaagcaacctcaacaccaagatcttcatcaccttccaagggctggagatcctcagcaatgtttttgatcttcctgccacctactcaggaggagatctgacatatggcaccttcaagtacaaggacaccctcctcatcccttctccagattttgagatcatcaccaccatcgacctcagcaatgacaacaagagcagcaacatcatcatcgacaagatcgagttcatccccatcaaggggccgctggaggattatgaagcaaatcaa

SEQ ID NO: 181 - DNA, 2406 bp, Artificial Sequence
  synthetic sequence encoding toxin protein
atgaaccagatctatgtcagcaatgttgctgaaattgaaggcatcaagagggccaaggagaaatatccagacagggagatccccgtctaccagcacaccgtcaccagccagaacctctgcgccaccatcaacccgccgacgctggtgatgaacaccgacatgagaggaacaaacaccttcgagaacaaggacagcttccaaaaaacacaaagctcagatctgaggaacatcaacctctctgaatggagagatcttggaggaaatgtcaactctcctcagttcaccaagcagcgcctcatcgacaatggacaaacatcattggacattgatctggagattggagtgacctccgccgccggcattgcttgggcgctgctgggcatctctcatcccatcggcagcgccgtcgccggcgtcgtcaatgtcatcctccccatcctctggccaacaacaacagaagatccagatgaagtttggaaatcaatgatgggaaatgctgaagctctggtggacaagaagattgatgaagcaatgaagaacctcgccatcagcaagctcaatggcctcaagaacagcatgaatgaatattgtcaagctcttgcaaggctgaaggcagatccaaacaaccccatcgagcaagcatctgtgaggagcgcctaccaaagcatggacatgctcttcctctactcaatgcctcaatttgctgttcctcaatttgaggtgcagctgctgccaacatatgctgaagctgccaacctccacctcctcttcatcagagatgctgtcaagtttggaaatgaatgggggatgacacaagctcagatcgacacagagtacaatgatctgaagaggctaacagaagaatacaccaaccactgcgtcaactggttcaacaccggcctccaaaggatggaccccttcaagaatccatcaaagaagcctgctgacatgtggaactgcacaacatatccatgggtggcatttgatcaatatgtgagctggtttggaacaacacaaaatcctccaaagaactgcaagagcaccctccaaacaagcatctgcgacaaccaaggaattgaaaatgattcagaagtcacgccgcagctgggaagctacagaggaagcaagagcgagtaccaagggctggagaactggaacctctacaacaacttcagaagagacatgaccatcatggtgctggatgtggtgagcagctggccaacatatgatcccatcaagtacagcatcggcggcatccagagcgagctgacaagagctctctacacccccatcagaggaacaacatacagatcagattcagcgcagaacaccatctccgccatcgagaacaggatgatccagaagcctcatctcttcacctggctcaacaggattgagttcaatgagctctgggttggagacaacctctacaccaaaggatatgtgctgattggaggaaagatcatcaggaagttcacctcagaaagcaccgtggaggagagctttggaaaatcagatccttctgcaaggaagatgaatgtggacatcaccccaaatgatcccatcaagaagatcatcacaaggcaatggtttgagccaagggagatcgagctctacaaaggagcaacatatctcttcaccttgggcaccatccaggagccaatgccaaacttcaccggcatcatcacctcaggctgctatccaactggaggagttccaaagccatgcatctatgatccaacaaggaaggagaacatgatgccaaaagctgttgatccaaacacaccaaatgctccaagaagccaatggaaggacagccaccgcctcagctacttcaaatatgagcccatcagaagcaactcaccatatggatatccttctcaaggccagatcggcgccgtggcgctggaatggacccacatgtcagtgaaccccaacaacaccattgctcttgacaagatcactcagatccctgctgtcaagggctgggagctccgcggcggcgccaaggtcatcaaggggccaggaagcactggaggagatctggtgcagctctctggagatttcaatgatctcaccgtccaggtcaccatcccttcttcagaggtgattggaggctacctcatcaggctgagatatgcaagcaacctcaacaccaagatcttcatcaccttccaagggctggagatcctcagcaatgtttttgatcttcctgccacctactcaggaggagatctgacatatggcaccttcaagtacaaggacaccctcctcatcccttctccagattttgagatcatcaccaccatcgacctcagcaatgacaacaagagcagcaacatcatcatcgacaagattgagttcatccccatcaaggggccgctggaagattatgaagcaaatcaa

SEQ ID NO: 182 - DNA, 1959 bp, Artificial Sequence
  synthetic sequence encoding toxin protein
atgaactacacagattgggtgaacagatgcaactgtggagaacctggagagctcttcaatgacaccaccaccgccgtcagaaatggcctcatcattggaactggagttggatgggcgctgctgggcctcatccccgtcattggaggaccagcttcagccattgctggcctcttcaatgtgctgatcccctactggtggccggagcaagctggaaatcctggaacagctcaagctcagttcacctgggagcagctgatgtcagctgttgaaaccatcaccgacaagaagatcctcaacttcaagaagagcgacgccattgcaagatggcaaggcatccagctgctgacaagggactactacctcaagctctgcgactggatcaatgatcaaacatcaccaagcaagcaagctgctgtcaaggatgcttttgatgatgtggaggactacatcaagatctccatgcccttctttgaagctcaaggcttccaagttcagatgctctccatgtatgctcaagctgcttcaatgcacctgctgctgctgagagatgtggtgaaatatggagttggatggggatatgagccatatgaggtggagagatactacagccacatcggcctcggcaacaagggcctcctccagctcattgctgactacacagatcactgcgtcgtctggtacaacaccggcctacaagagcagtacaacaccggcgactggaacaagttcaatgatttcagaagggacatgaccatcatggtgctggacattgtttcaatctggccaacatttgatccaaggctctacaccgtgccaacaaagagccagctgacaaggaccgtctacacaagagtttctggagacaccggcggcggcaacatcaccgtggagccgacgctgcccattgatgtggtggagagcaatgtggtggacatcccgcgcctcttcagctggctgagggagctcaccattgatgctgacaacttcccttcttcatctcctggaagatttgacatgaaaggaagaggcctcaagcgtcaaaacaccttgagcaacaccatcgaggttggaggctacaaaggagaagctggcaacaggcagcaaaccctctccatcccttcacctcaaagcaatgatgatgtttggaagatcgacaccttgatcaggatcgccttcaatgatggaagccgcgccgtcaatggctgggacttcaagttcacccaatctccaaaccagcacctctatggaactcccttcttccctcaagaagttgctggcttcccctgcaagggccagaacctccggccatgtgaaccctgcgtcagctgctcctcagagctgccggacatgaatgttccctgcaatgacaagagcttgtacagccaccgctacagctacatggggctggggatgctcacctacaacagcaccacccccttcagatatgctgcctacttcagcaatggatggacccatgtttcagctgatgccaacaacctcatcgacctggagaagatcacccagatccccgccgtcaagggctacagcttgacaggaacaagcagggtgatcaaggggccaggaagcactggaggagatctggtgaagctctccgcctcagggatgctggggctggccatcactgaaccttctggaacacatgcctacagggtgaggatcagatatgcttgcaacatggacatcaacatcctggtgctgaatgaggtgacagcagagctgggaaggttcattgctcctgccaccaccaccgacatgacaaacttgacatatgacaagtttggctacctggacaccttggtgtacagctactcaagcctggaggatgtcaacaatggcctcaacatctacaacctgggctctgatgaagccaccatcatcctggacaagatcgagttcatccccatccaaggaagcgtggagacatatgaagcagatcaa

SEQ ID NO: 183 - DNA, 1959 bp, Artificial Sequence
  synthetic sequence encoding toxin protein
atgaactacacagattgggtgaacagatgcaactgtggagaacctggagagctcttcaatgacaccaccaccgccgtcagaaatggcctcatcattggaactggagttggatgggcgctgctgggcctcatccctgtcattggaggaccagcttcagcaattgctggcctcttcaatgtgctgatcccctactggtggccagagcaagctggaaatcctggaacagctcaagctcagttcacctgggagcagctgatgtcagctgttgaaaccatcaccgacaagaagatcctcaacttcaagaagagcgacgccattgcaagatggcaaggcatccagctgctgacaagagattactacttgaagctctgcgactggatcaatgatcaaacatcaccaagcaagcaagctgctgtcaaggatgcttttgatgatgtggaggactacatcaagatctccatgcccttctttgaagctcaaggcttccaagttcagatgctctccatgtatgctcaagctgcttcaatgcatctgctgctgctgagagatgtggtgaaatatggagttggatggggatatgaaccatatgaggtggaaagatactacagccacattggcctcggcaacaagggcctcctccagctcattgctgattacacagatcactgcgtcgtctggtacaacaccggcctacaagagcagtacaacactggagactggaacaagttcaatgatttcagaagagacatgaccatcatggtgctggacattgtttcaatctggccaacatttgatccaaggctctacactgttccaacaaaaagccagctgacaagaactgtctacacaagagtttctggagacaccggcggcggcaacatcaccgtggagccgacgctgccaattgatgtggtggagagcaatgtggtggacatcccaaggctcttcagctggctgagggagctcaccattgatgctgacaacttcccttcttcatctcctggaagatttgacatgaaaggaagaggcctcaagcgtcaaaacaccttgagcaacaccattgaagttggaggatacaaaggagaagctggaaacaggcagcaaaccctctccatcccttcacctcaaagcaatgatgatgtttggaagatcgacaccttgatcaggatcgccttcaatgatggaagccgcgccgtcaatggatgggacttcaagttcacccaatctccaaaccagcatctctatggaactcccttcttccctcaagaagttgctggcttcccctgcaaaggccaaaacctccggccatgtgaaccatgtgtcagctgctcttcagagctgccagacatgaatgttccatgcaatgacaagagcttgtacagccaccgctacagctacatggggctggggatgctcacctacaacagcaccacccccttcagatatgctgcatacttcagcaatggatggacacatgtttcagctgatgcaaacaacctcatcgacctggagaagatcacccagatccctgctgtcaagggctacagcttgacaggaacaagcagggtgatcaaaggaccaggaagcactggaggagatctggtgaagctctccgcctcagggatgctggggctggccatcactgaaccttctggaacacatgcctacagggtgaggatcagatatgcttgcaacatggacatcaacatcttggtgctgaatgaggtgacagcagagcttggaagattcattgctcctgccaccaccaccgacatgacaaatttgacatatgacaagtttggctacctggacaccttggtgtacagctattcaagcctggaagatgtcaacaatggcctcaacatctacaaccttggatctgatgaagcaaccatcatcctggacaagattgagttcatccccatccaaggatctgtggaaacatatgaagcagatcaa

SEQ ID NO: 184 - DNA, 1989 bp, Artificial Sequence
  synthetic sequence encoding toxin protein
atgaaccagaactacaaccacaacaactatgagatcctggacaatggcaacagggactaccagccaagatatcctcttgctcaagctccctgctcagagctgcaaaacatgaactaccaagatgtgatgaacaccagcattggaagagaatatcaagctgtgcagcaggtgaatgttggtgaagctgtctccgccgcgctgggcatcctcaccaccatcctcaaggccgccaaccccaccctcggcgccgccgccggcgtcatctcaagcatcttcggcttcctctggaagagatttggaacagatcctcaagctcaatggaagcagttcatggatgctgtggagtacctggtgaaccagaagatcactgatgctgtgaggagcaaggctgtttcagagctggaaggagttcaaagagctctggagctctaccaagaagctgctgatgattggaacatgagcccaaatgatgctgatgccaaggagaggatcaggaggcagttcacctcaacaaacaccgtcattgaatatgccatgccctccttcagagttgatggcttcgaggtgccgctgctcaccacctttgctcaagctgccaacctccacctgctgctgctgagagatgctgtcaagtttggagctggatggggccttccttcagcagaggtggaggacaactacacaaggctgcaagcaaggacggcggagtacaccaaccactgcaccaacacatatgacaaggggctgaagcaagcatatgatcttgctccaaatccaacagactacaacaagtacccctacctcaaccctcattcaaaagatcccatctatggcaagtactacaccgcgccggtggactggaacctcttcaatgatttcagaagggacatgacattaatggtgctggacatcgtcgccgtctggccaacatacaacccgcgcctctacaacaacccatatggcgtccagatccagctcagcagggaggtgtacagcaccgtctatggaagaggaggaagcaccaacagcactgttgatgccatcgagagcaccttggtgaggccgccgcacctggtgacagagctcaccaagctaacatttgatgaaaggaacctctatgaagcagaaacagttcctgtggccttcaagaaggtcaccaacaccttgagaaatgttggaagcagcaccacctgggagcagagcttctcctcaactggaggaagcctcaagaccgtccacaatgtttgggccaccgacatcggcaacctctccctcaacctcggcgccgtgccgctgggcttctccttctacaatgaaaatgatcagcacctgaccaccgtcggctacagcggcggcctctggaatggcatccctaaaggagaaggaagcaaccagaacagccaccacctctcatatgttgctgctctggagacacaaagcaccgccggctggtggccatacacctacccggtgaacctgctgggagaatggggctttggatggctacacaacagcctcaccttggacaacaggatcgccactgacaagatcacccagatccccgccgtcaaggccttcaagctcaccccctacaacaacaacaccaaggtcatcaaggggccaggaagcactggaggagatctgatccagctggcttctggcttccttcagtacagcttcccctccaccgacaacaggcagtacaggatcaggatcagatatgcttcagctgatggctcggcgctccgcctccgccaatggattggaaatggagtttctgacagcacccacaacctgccaaaaacatacagctcagggccgctgacctacaacaccttcgccatcttcgacactggaaggatcatgcaaacaacaagcagcttcgagctctggctggacaacatcggcagcggcaccctcatcatcgacaagatcgagttcatccccatcaaccccatcgagagcccgccggagccaaagccgccggtg

SEQ ID NO: 185 - DNA, 1989 bp, Artificial Sequence
  synthetic sequence encoding toxin protein
atgaaccaaaactacaaccacaacaactatgagatcttggacaatggaaacagagactaccagccaagatatcctcttgctcaagctccatgctcagagctgcaaaacatgaactaccaagatgtgatgaacaccagcattggaagagaatatcaagctgttcagcaggtgaatgttggtgaagctgtctccgccgcgctgggcatcctcaccaccatcctcaaggctgccaacccaaccctcggcgccgccgccggcgtcatctcaagcatctttggcttcctctggaagagatttggaacagatcctcaagctcaatggaagcagttcatggatgctgtggagtacctggtgaaccagaagatcactgatgctgtcagaagcaaagctgtttcagagctggaaggagttcaaagagctctggagctctaccaagaagctgctgatgattggaacatgagcccaaatgatgctgatgcaaaggagaggatcagaaggcagttcacctcaacaaacaccgtcattgaatatgccatgccatccttcagagttgatggatttgaggtgccgctgctcaccacctttgctcaagctgcaaacctccatctgctgctgctgagagatgctgtcaagtttggagctggatggggccttccttcagcagaggtggaggacaactacacaaggctgcaagcaaggacagcagagtacaccaaccactgcaccaacacatatgacaaaggcttgaagcaagcatatgatcttgctccaaatccaacagattacaacaagtacccctacctcaatcctcattcaaaagatcccatctatggaaaatactacaccgcgccggtggattggaacctcttcaatgatttcagaagagacatgacattaatggtgctggacatcgtcgccgtctggccaacatacaatcctaggctctacaacaatccatatggagttcagatccagctctcaagggaggtgtacagcaccgtctatggaagaggaggaagcaccaacagcactgttgatgccattgaaagcaccttggtgaggccgcctcatctggtgacagagctcaccaagctaacatttgatgaaagaaacctctatgaagcagaaacagttcctgttgccttcaagaaggtgacaaacaccttgagaaatgttggaagcagcaccacctgggagcagagcttctcttcaactggaggaagcctcaagacagttcacaatgtttgggcaacagacattggaaacctctccttgaacctcggcgccgtgccgctgggcttctccttctacaatgaaaatgatcaacatctgaccaccgtcggctacagcggcggcctctggaatggcattcctaaaggagaaggaagcaaccaaaacagccatcatctttcatatgttgctgctctggaaacacaaagcactgctggctggtggccatacacctatccagtgaaccttcttggagaatggggatttggatggctacacaacagcttgaccttggacaacaggattgcaactgacaagatcacccagatccctgctgtcaaggccttcaagctcaccccctacaacaacaacaccaaggtcatcaaaggaccaggaagcactggaggagatctgatccagctggcttctggcttccttcagtacagcttcccttccaccgacaacaggcagtacaggatcaggatcagatatgcttcagctgatggaagtgctctccgcctccgccaatggattggaaatggagtttctgattccacccacaaccttccaaaaacatattcatcagggccgctgacctacaacaccttcgccatcttcgacactggaaggatcatgcaaacaacaagcagcttcgagctctggctggacaacattggaagcggcaccttgatcatcgacaagattgagttcatccccatcaaccccattgaaagcccgccggagccaaagccgccggtg

SEQ ID NO: 186 - DNA, 2052 bp, Artificial Sequence
  synthetic sequence encoding toxin protein
atgaacctcaatgacaacaagaatgaatttgagatcatggatcatggaagcatgggctaccagccaaaatatcctctggccaaggagagcgtgccaactggccagaacatgaactacacagattggatgaacagatgtgcaaatggagaagttgatgtttttggagacacctcaggaagcgtcagaaatgctctgatctatggaactggagttggatgggcgctgctgggcttcatccccgtcattggaggaccagcttcagccattgctggcctcttcaatgtgctgctgccatattggtggcctgaacaagctggagcttctggatctcctcaagctcagtacacctgggcgcagctgatggctggaagcgaggagatcaccgacaagaagatcctggagagcaagaagagcgacgccattgcaagatggcaaggcatccaatcaatgggccgcgtctactatgagaagctctgcgactggattggagatcaaaacaatgaggtgaagaaggaccgcctcagagatgcttttgatgatctggatgacaggatcagggtttcaatgccgcacttccaagctcaaaccttcgaggttcagatgctctccatgtatgctcaagctgccaacatgcacctgctgctgctcagagatgtggtgacaaatggcaccaactggggcttcgagcagtttgaggtggacagatattattcaaatgctgatggccttggaaatcctggcctcctccagctgctgaacagctacaccaactactgcatcgactggtacaacaccggcctccaggagcaatatgacactggagattggaacaagttcaacaacttcagaacaacaatgaccatctcagtgctggacaccgtcgccacctggccaacatttgatccaaagttctacagcctccccaccaagagccagctgacaaggatcgtctacacgccgcgcgtcggcgacacagcaagaagcaacaggccatcagcaagcattgatgctcaagaaaacaacatcgtcagctcgccgcgcctcttcgcctggctgaggatggtggatgtttctctccagaagaatggcctctcaaatgagatcgccagctacaagcagaccttccacaacaccctccacaccaacctctggagcatcaccaagggcacgccaacaaatgatgtgaggaacatgttcaccaccccctacttcccatatgatgacatctggaagatcaagaatgagttctttgattatgattcaccatttgatgatcttgctgtggacaactggaccttctccttcagatattctgatgatcaatattttgagctctccacatatgacaagagcgtgacaaggttctatggcctcccctgccgcgccaagaactcaggcatctgtgatccatgtgacagccaaaatccatgccgcaaagagctgccaaacactacaatgccatgtgaggacaagaggctctacagccaccgcctcgcctacatgggagctggagaaaatgtctacccgccgccatcattgacctacagcgcctatggatggacccatgtttctgctgatgctgacaacaggattgatgctgagaagatcacccagatccccgccgtcaaaggaagctggctcaatgaaggaactgtcatcaaggggccaggatcaactggaggagatctcatccagctgcacagctatggaacaagcattgctctctccgtcaccatccctgctggcatccaaacatacagggtgaggatcagatatgcttcaaatgctgatcttcccatcctggtgagcttgggctacagcggcctggacaccttcattgctcctgccaccaccagcgacctcaccaagctcacctacaacaagttcgcctacctggacaccttggtgttcacctcaagagaagatccaaatggcctctatgagcagctgatcttcatccgccacaatggcctggagagcaggaccttcatcatcgacaagatcgagttcatccccatcaagggcagcgtcgccgagtatgaagcaagccaa

SEQ ID NO: 187 - DNA, 2052 bp, Artificial Sequence
  synthetic sequence encoding toxin protein
atgaacctcaatgacaacaagaatgaatttgagatcatggatcatggaagcatgggctaccagccaaaatatcctctggccaaggagagcgtgccaactggacaaaacatgaactacacagattggatgaacagatgtgcaaatggagaagttgatgtttttggagacacctcaggaagcgtcagaaatgctctgatctatggaactggagttggatgggcgctgctgggcttcatccctgtcattggaggaccagcttcagcaattgctggcctcttcaatgtgctgctgccatattggtggcctgaacaagctggagcttctggatctcctcaagctcagtacacctgggcgcagctgatggctggatcagaggagatcaccgacaagaagatcctggagagcaagaagagcgacgccattgcaagatggcaaggcatccaatcaatgggccgcgtctactatgagaagctctgcgactggattggagatcaaaacaatgaggtgaagaaggaccgcctcagagatgcttttgatgatcttgatgacaggatcagagtttcaatgcctcacttccaagctcaaacatttgaagttcagatgctctccatgtatgctcaagctgccaacatgcatctgctgctgctcagagatgtggtgacaaatggaacaaactggggcttcgagcagtttgaggtggacagatattattcaaatgctgatggccttggaaatcctggcctcctccagctgctgaacagctacaccaactactgcattgattggtacaacaccggcctccaggagcaatatgacactggagattggaacaagttcaacaacttcagaacaacaatgaccatctcagtgctggacaccgtcgccacctggccaacatttgatccaaagttctacagcctccccaccaagagccagctgacaaggatcgtctacacgccgcgcgtcggcgacacagcaagaagcaacaggccatcagcaagcattgatgctcaagaaaacaacatcgtcagctcgccgcgcctcttcgcctggctgaggatggtggatgtttctctccagaagaatggcctctcaaatgagattgcaagctacaagcaaaccttccacaacaccctccacaccaacctctggagcatcaccaagggaacaccaacaaatgatgtgaggaacatgttcaccaccccctacttcccatatgatgacatctggaagatcaagaatgagttctttgattatgattcaccatttgatgatcttgctgtggacaactggaccttctccttcagatattctgatgatcaatattttgagctctcaacatatgacaagagcgtgacaaggttctatggcctcccctgccgcgccaagaactcaggcatctgtgatccatgtgacagccaaaatccatgccgcaaagagctgccaaacactacaatgccatgtgaggacaagaggctctacagccaccgcctcgcctacatgggagctggagaaaatgtctacccgccgccatcattgacatacagcgcctatggatggacacatgtttctgctgatgctgacaacaggattgatgctgagaagatcacccagatccctgctgtcaaaggaagctggctcaatgaaggaactgtcatcaaggggccaggatcaactggaggagatctcatccagctgcacagctatggaacaagcattgctctctccgtcaccatccctgctggcatccaaacatacagggtgaggatcagatatgcttcaaatgctgatcttcccatcctggtgagcttgggctacagcggcctggacaccttcattgctcctgccaccaccagcgacctcaccaagctcacctacaacaagttcgcctacctggacaccttggtgttcacctcaagagaagatccaaatggcctctatgagcagctgatcttcatcaggcacaatggcctggagagcaggaccttcatcatcgacaagattgagttcatccccatcaagggcagcgtcgctgaatatgaagcaagccaa

SEQ ID NO: 188 - DNA, 2049 bp, Artificial Sequence
  synthetic sequence encoding toxin protein
atgtcgccaaacaaccaaaatgaatatgagatcattgatgcaacaccaagcacctccgtcagcaatgacagcaacagatatccatttgcaaatgagccaacaaatgctctccagaacatgaactacaaggagtacctctccatgtcagaaggatatgacagagaatattttgcttctcctggagctctggtgagcggcaagcaggccatcaaggtgggcatcgacatcgtcggcaagatcctcggcgcgctgggcatcccctttgttggagaaattgttggcttctacaacttcatccttgatcagctctggccatcaaacagcgtcagcatctgggagcagatcatgacgctggtggaggagctggtggaccagaagatcacagaatatgcaaggaacaaggccattgctgagctaactggccttggaaatgccatggatgtctaccagcagagcttggaggactgggtggccaacccaaatgatgcaaggacaaggagcgtggtggccacccagttcaccgcgctggagctggattttgttcaagccatcccctccttcgccatctcaggccaagaagttcctctcctcggcgtctatgctcaagctgtcaacctccacctgctgctgctgagagatgcttccatctttggagaagaatggggcttctcctcctctgagatcagcagatactacaacaggcaggtgcagctcaccagccaatattcagattactgcgtcaaatggtacaacaccggcctccagaagctgaaaggaacttctgctgagaactggctggagtaccaccagttcagaagggagatgaccttcatggtgctggatctggtggcgctcttccccaactacaacacccacatgtacccgctggaaacaaaagctcagctaacaagggaggtgtacacagatccaattgccttcaacctctctggagctgctggcttctgctcgccatggagcaagtacaccggcatcagcttctcagagattgaaaatgctgtcatcaggccgccgcacctcttcaatgtgctgaggagcttggagatcaacaccgtccgcggcaccatcctcggcaacaccaaggacttccagaactactggagcggccacagcttgagatacaacttcatcggcaacaccaccatctcagaaagcaactatggctacctcacctcagaaaaaacaaggattgagctggacacaagggacatcttcgagatcaacagcaccgccgccaacctcgccaactactaccagcaagtttatggagttcctcaaagcggcttccacatggtgagatgggattctccctacaacacctccacccagctctacagcaagacctacaccacgcctaaagattgcacccaggtgtaccagagctcagaggagatcccggtggagaggacagttcctgtcaatgaaggctacagccaccgcctgagctatgtcaccagcttcgacttctcaaagatcatcaacagcttcgtcagaaatggaaatcttcctgtttttgtttggacccaccgctccgccgacctcaccaacaccatctaccctgatgtcatcacccagatcccggtggtgaaggcatatgctcttggaagcagcatccttcctggatctccttcaccaaccattgttcctggacctggcttcaccggcggcgacatcatccagctgctggccaacaccaagggcattgcctacatgaacttcgagatccaggacatcaacaaggagtacatcatgaggatcagatatgcttctgctgcaaatcctgagttcaacattgctgttggaacatcaggagaaagggtgagcacctcggcgcagaaaacaatgaaccctggagacatcctcaccttcaacaagttcaactacgccaccttccctcccatcaagttcaacagcaccaagatctccattgctctcaccgcctccctcgccgccttcgcctccaccctgctggagacatacatcgacaggatcgagttcatccctgttgatgaaacatatgaagcagaagct

SEQ ID NO: 189 - DNA, 2049 bp, Artificial Sequence
  synthetic sequence encoding toxin protein
atgtctccaaacaaccaaaatgaatatgagatcattgatgcaacaccaagcacctccgtcagcaatgacagcaacagatatccatttgcaaatgaaccaacaaatgctcttcaaaacatgaactacaaggagtacctctccatgtcagaaggatatgacagagaatattttgcttctcctggagctctggtgagcggcaagcaggccatcaaggtgggcatcgacattgttggcaagatcctcggcgcgctgggcatcccctttgttggagaaattgttggcttctacaacttcatccttgatcagctctggccatcaaattctgtcagcatctgggagcagatcatgaccttggtggaggagctggtggatcagaagatcacagaatatgcaaggaacaaggccattgctgagctaactggccttggaaatgccatggatgtctaccagcagagcttggaggactgggtggcaaatccaaatgatgcaagaacaagaagcgtggtggccacccagttcaccgcgctggagctggattttgttcaagccatcccttccttcgccatctcaggacaagaagttcctctcctcggcgtctatgctcaagctgtcaacctccatctgctgctgctgagagatgcttccatctttggagaagaatggggcttctcctcctctgagatctcaagatactacaacaggcaggtgcagctcaccagccaatattcagattactgcgtcaaatggtacaacaccggcctccagaagctgaaaggaacttctgctgaaaactggctggagtaccaccagttcagaagagagatgaccttcatggtgctggatctggtggcgctcttccccaactacaacacccacatgtatcctctggaaacaaaagctcagctaacaagggaggtgtacacagatccaattgccttcaacctctctggagctgctggcttctgctctccatggagcaagtacaccggcatcagcttctcagaaattgaaaatgctgtcatcaggccgccgcacctcttcaatgtgctgaggagcttggagatcaacaccgtccgcggcaccatcctcggcaacaccaaggacttccagaactactggagcggccacagcttgagatacaacttcatcggcaacaccaccatctcagaaagcaactatggctacctcacctcagaaaaaacaaggattgagctggacacaagggacatcttcgagatcaacagcaccgccgccaacctcgccaactactaccagcaagtttatggagttcctcaaagtggcttccacatggtgagatgggattctccatacaacacctccacccagctctacagcaagacatacaccactcctaaagattgcacccaggtgtaccaaagctcagaagagattcctgtggagaggacagttcctgtcaatgaaggatacagccaccgcctgagctatgtcaccagcttcgacttctcaaagatcatcaacagcttcgtcagaaatggaaatcttcctgtttttgtttggacccaccgctccgccgacctcaccaacaccatctatcctgatgtcatcacccagattcctgtggtgaaggcatatgctcttggaagcagcatccttcctggatctccttcaccaacaattgttcctggacctggcttcaccggcggcgacatcatccagctgctggccaacaccaagggcattgcctacatgaactttgagatccaggacatcaacaaggagtacatcatgaggatcagatatgcttctgctgcaaatcctgagttcaacattgctgttggaacatcaggagaaagggtgagcacctctgctcagaaaacaatgaatcctggagacatcctcaccttcaacaagttcaactatgccaccttccctcccatcaagttcaacagcaccaagatctccattgctctcaccgcctccctcgccgccttcgcctccaccttgctggaaacatacatcgacaggattgagttcatccctgttgatgaaacatatgaagcagaagct

SEQ ID NO: 190 - DNA, 1932 bp, Artificial Sequence
  synthetic sequence encoding toxin protein
atgaactacaaggagtacctctccatgtcagaaggatatgacagagaatattttgcttctcctggagctctggtgagcggcaagcaggccatcaaggtgggcatcgacatcgtcggcaagatcctcggcgcgctgggcatcccctttgttggagaaattgttggcttctacaacttcatccttgatcagctctggccatcaaacagcgtcagcatctgggagcagatcatgacgctggtggaggagctggtggaccagaagatcacagaatatgcaaggaacaaggccattgctgagctaactggccttggaaatgccatggatgtctaccagcagagcttggaggactgggtggccaacccaaatgatgcaaggacaaggagcgtggtggccacccagttcaccgcgctggagctggattttgttcaagccatcccctccttcgccatctcaggccaagaagttcctctcctcggcgtctatgctcaagctgtcaacctccacctgctgctgctgagagatgcttccatctttggagaagaatggggcttctcctcctctgagatcagcagatactacaacaggcaggtgcagctcaccagccaatattcagattactgcgtcaaatggtacaacaccggcctccagaagctgaaaggaacttctgctgagaactggctggagtaccaccagttcagaagggagatgaccttcatggtgctggatctggtggcgctcttccccaactacaacacccacatgtacccgctggaaacaaaagctcagctaacaagggaggtgtacacagatccaattgccttcaacctctccggcgccgccggcttctgctcgccatggagcaagtacaccggcatcagcttctcagagattgaaaatgctgtcatcaggccgccgcacctcttcaatgtgctgaggagcttggagatcaacaccgtccgcggcaccatcctcggcaacaccaaggacttccagaactactggagcggccacagcttgagatacaacttcatcggcaacaccaccatctcagaaagcaactatggctacctcacctcagaaaaaacaaggattgagctggacacaagggacatcttcgagatcaacagcaccgccgccaacctcgccaactactaccagcaagtttatggagttcctcaaagcggcttccacatggtgagatgggattctccctacaacacctccacccagctctacagcaagacctacaccacgcctaaagattgcacccaggtgtaccagagctcagaagaaattcctgtggagaggacagttcctgtcaatgaaggctacagccaccgcctcagctatgtgacctccttcgacttctcaaagatcatcaacagcttcgtcagaaatggaaatcttcctgtttttgtttggacccaccgctccgccgacctcaccaacaccatctaccctgatgtcatcacccagatcccggtggtgaaggcatatgctcttggaagcagcatccttcctggatctccttcaccaaccattgttcctggacctggcttcaccggcggcgacatcatccagctgctggccaacaccaagggcattgcctacatgaacttcgagatccaggacatcaacaaggagtacatcatgaggatcagatatgcttctgctgcaaatcctgagttcaacattgctgttggaacatcaggagaaagggtgagcacctcggcgcagaaaacaatgaaccctggagacatcctcaccttcaacaagttcaactacgccaccttccctcccatcaagttcaacagcaccaagatctccattgctctcaccgcctccctcgccgccttcgcctccaccctgctggagacatacatcgacaggatcgagttcatccctgttgatgaaacatatgaagcagaagct

SEQ ID NO: 191 - DNA, 1932 bp, Artificial Sequence
  synthetic sequence encoding toxin protein
atgaactacaaggagtacctctccatgtcagaaggatatgacagagaatattttgcttctcctggagctctggtgagcggcaagcaggccatcaaggtgggcatcgacattgttggcaagatcctcggcgcgctgggcatcccttttgttggagaaattgttggcttctacaacttcatccttgatcagctctggccatcaaattctgtcagcatctgggagcagatcatgaccttggtggaggagctggtggatcagaagatcacagaatatgcaaggaacaaggccattgctgagctaactggccttggaaatgccatggatgtctaccagcagagcttggaagattgggtggcaaatccaaatgatgcaagaacaagaagcgtggtggccacccagttcaccgcgctggagctggattttgttcaagccatcccttccttcgccatctcaggacaagaagttcctctcctcggcgtctatgctcaagctgtcaacctccatctgctgctgctgagagatgcttccatctttggagaagaatggggcttctcttcttctgagatctcaagatactacaacaggcaggtgcagctgacaagccaatattcagattactgcgtcaaatggtacaacaccggcctccagaagctgaaaggaacttctgctgaaaactggctggagtaccaccagttcagaagagagatgaccttcatggtgctggatctggtggcgctcttccccaactacaacacccacatgtatcctctggaaacaaaagctcagctaacaagggaggtgtacacagatccaattgccttcaacctctccggcgccgccggcttctgctctccatggagcaagtacactggcatcagcttctcagaaattgaaaatgctgtcatcaggccgccgcacctcttcaatgtgctgaggagcttggagatcaacaccgtccgcggcaccatcctcggcaacaccaaggacttccagaactactggagcggccacagcttgagatacaacttcattggcaacaccaccatctcagaaagcaactatggctacctcacctcagaaaaaacaaggattgagctggacacaagagacatctttgagatcaacagcaccgccgccaacctcgccaactactaccagcaagtttatggagttcctcaaagtggcttccacatggtgagatgggattctccatacaacacctccacccagctctacagcaagacatacaccactcctaaagattgcacccaggtgtaccaaagctcagaagaaattcctgtggagagaacagttcctgtcaatgaaggatacagccaccgcctcagctatgtgacctccttcgacttctcaaagatcatcaacagcttcgtcagaaatggaaatcttcctgtttttgtttggacccaccgctccgccgacctcaccaacaccatctatcctgatgtcatcacccagattcctgtggtgaaggcatatgctcttggaagcagcatccttcctggatctccttcaccaacaattgttcctggacctggcttcaccggcggcgacatcatccagctgctggccaacaccaagggcattgcttacatgaactttgagatccaagacatcaacaaggagtacatcatgaggatcagatatgcttctgctgcaaatcctgagttcaacattgctgttggaacatcaggagaaagggtgagcacctctgctcaaaaaacaatgaatcctggagacatcctcaccttcaacaagttcaactatgccaccttccctcccatcaagttcaacagcaccaagatctccattgctctcaccgcctccctcgccgccttcgcctccaccttgctggaaacatacatcgacaggattgagttcatccctgttgatgaaacatatgaagcagaagct

SEQ ID NO: 192 - DNA, 1875 bp, Artificial Sequence
  synthetic sequence encoding toxin protein
atgcagccaagcagccagaacaaccctgttccctacagcacctcgccggcctacacccaaacaaacctccagttcatctcagatcttgatccaaccctcaacttcttcaagaagctgaagatcggcctcatcaatggacaatatgttgaggtcatcatggagatctgggagagcgtcaagatgcacaagatcaactacctctccttcgtcgacctctccatcagcttgatcaccatctctgttcctcatgttggcatcaccgtgcccttcctcaacctcttcttctcagagttcaccggcaactacagcgcgctgcccatccctgacatcttcaccgccatcatctatgacacccagaacatgttcaaccaaaatctaacaacagatcaagaaaacctcaacaccatgatcaaggagttcaagcagaacatggagaactacaagaaggagctggtgacgctggaggagaacagcgaggtgttcttcgacaccttcgaccacactgacaagctgctcaccgacaccatcaaccagttcattgtttcagactacacccagctgcacaccccctacttcgccatcttcgccaccatccacctgatgatccaccgtgatgtcatcatccatggaggaaaatggggcttctccgacatcttcatccacaagaagaggaacaacatcaagaagctgatccagaagtacctcttcattggatcaaacctcttcaagaaggagctggacaacctgctggcttctcaaagtgagctggaggtgcacaccctgccaagccacatccagaagttccctctctacatccccaacatctacaggctctggccaagcctagatccaaacatctaccccaactacacagagctgggaaaaacagagctgctgctggtgcatccaactgtcatcatcgagagcaacctcttcaccaacaacatccacaccaatgacaatgagctcacctccatgaatgccaacatcagcagctacctcaacagcatcctgccggaggtgaacaacaagcacctccacatgtatgctccaagggagatcccttcagagaacatcatcggcaccattgatgtctgccctgacatcctccccatcaagatcaccagcctctccatcgtcaactatgatgacaaccaaggagaaacagtgacagaatggatcaatggaggaagcatcgtcaagctccagttcaagcaggtggtcaccgtcagcttcatcaacctctacaaccatgcctaccagatcaggctaagatatgcaactgagtacaacaaggaggccatcatctgggtctgcatcagggacaaccaaactggaaaaaccctcctcaacagcaagctctccttctcagcgccgacggacagcaacagcatccaaggagaatatggcaagtacatcgtcaacatcatcatgaatggagaacatgacaccaagaaaaccaccgtctatgctggaagctacaccatcttcatcaagaacttaatggaggagaacctcttcctggacaggctggagttctgcaagaagcccatcaagaacaacaccctcatcgtgctgccaacaagggagctcaactcgccgccggccggcggcattggatggaccaacctctggattgctgaatgcaacaggattggaacagcatttgaagctgtcactgctgttgctgaaggagaatacaggttctactacaagggcaacctagtgggcgtcatccaaggaacaaccttctatgagaacttcgacaccgtccagatctacttccacaactgcgtcgtcaacaccatcaacctcttcaccggcgccaacatctggacagaagatgacagccaagaatgcttcaagaacaatgaa

SEQ ID NO: 193 - DNA, 1875 bp, Artificial Sequence
  synthetic sequence encoding toxin protein
atgcagccaagcagccagaacaaccctgttccctacagcacctcgccggcctacacccaaacaaacctccagttcatctcagatcttgatccaaccctcaacttcttcaagaagctgaagattggcctcatcaatggacaatatgttgaggtcatcatggagatctgggagagcgtcaagatgcacaagatcaactacctctccttcgtcgacctctccatcagcttgatcaccatctctgttcctcatgttggcatcaccgtgcccttcctcaacctcttcttctcagagttcaccggcaactacagcgcgctgcccatccctgacatcttcaccgccatcatctatgacacccagaacatgttcaaccaaaatctaacaacagatcaagaaaacctcaacaccatgatcaaggagttcaagcagaacatggagaactacaagaaggagctggtgacgctggaggagaacagcgaggtgttcttcgacaccttcgaccacactgacaagctgctcaccgacaccatcaaccagttcattgtttcagattacacccagctgcacaccccctacttcgccatcttcgccaccatccacctgatgatccaccgtgatgtcatcatccatggaggaaaatggggcttctccgacatcttcatccacaagaagaggaacaacatcaagaagctgatccagaagtacctcttcattggatcaaacctcttcaagaaggagctggacaacctgctggcttctcaaagtgagctggaggtgcacaccctgccaagccacatccagaagttccctctctacatccccaacatctacaggctctggccaagcctagatccaaacatctaccccaactacacagagctgggaaaaacagagctgctgctggtgcatccaactgtcatcatcgagagcaacctcttcaccaacaacatccacaccaatgacaatgagctcacctccatgaatgccaacatcagcagctacctcaacagcatccttccagaggtgaacaacaagcacctccacatgtatgctccaagggagatcccttcagagaacatcatcggcaccattgatgtctgccctgacatcctccccatcaagatcaccagcctctccatcgtcaactatgatgacaaccaaggagaaacagtgacagaatggatcaatggaggaagcatcgtcaagctccagttcaagcaggtggtcaccgtcagcttcatcaacctctacaaccatgcctaccagatcaggctaagatatgcaactgaatacaacaaggaggccatcatctgggtctgcatcagggacaaccaaactggaaaaaccctcctcaacagcaagctctccttctcagcgccgacggacagcaacagcatccaaggagaatatggcaagtacatcgtcaacatcatcatgaatggagaacatgacaccaagaaaaccaccgtctatgctggaagctacaccatcttcatcaagaacttaatggaggagaacctcttcctggacaggctggagttctgcaagaagcccatcaagaacaacaccctcatcgtgctgccaacaagggagctcaactcgccgccggccggcggcattggatggaccaacctctggattgctgaatgcaacaggattggaacagcatttgaagctgtcactgctgttgctgaaggagaatacaggttctactacaagggcaacctagttggcgtcatccaaggaacaaccttctatgagaacttcgacaccgtccagatctacttccacaactgcgtcgtcaacaccatcaacctcttcaccggcgccaacatctggacagaagatgacagccaagaatgcttcaagaacaatgaa

SEQ ID NO: 194 - DNA, 2007 bp, Artificial Sequence
  synthetic sequence encoding toxin protein
atgaacagctaccagaacaagaacaagaatgaatatgagatcctggacaccagcagaagcagcagcaccatgagcacaagatatccaagatatcctcttgctgaaaatcctcagatctccatgcaaaacaccaactacaaggactggatcaacatgtgcgcctcaaggaacctggaggatggcatctaccccacctccgccaatgatgtgatcaccaacagcatcaacatcagcagctacatcctctccatgctggggatgccaaacctctcctccatcattgccatctggggcgtcctcttcaatgccttctggcctgttagtggaaatcaatgggagcactacatgaaccatgttcaagctctcatcaagagggagctacaagcatttgcaagggagcaagctctccgccagctggaaggcctcggcggcaacctcggcctctacaaggaggcgctggctgaatgggagcaggacagggacaaccccaccaccaaggagagggtgagggacaggttcagaatcttggatggcttcttcacccagtacatccctgtgttccggatccaaggatatgaggtgcagctgctctcaatctatgccaaggtggtgaacctccacctgctgctgctgagagatgcttccatgttcggcgccgactgggggatgagccaaacaaacatcaatgacaactacaacaggcagatgaagctcaccagcctctacaccaaccactgcgtggacttctacaaccaaggcctcaatgaagcaagagctctctcaaacagcagctgggacatcttcaatgactacaggagggagatgaccctcaccgtgctggacattgttgctctcttccctgcatatgactacagaagatatcccatcaccaccaaggtggagctgacaagggagatctacacgccggccattgcttcacaaacatggagcaaccacaaccacctctctccaaatgtcaacttccagttctatgagaacaacctggtgaggccgccggccttcttcacctggctggacaggacagagatgttctcaaggaacctctccatcgaggtttcagaagcatggggaggccacatcaaccacttccaccacactggagagcagccgctctcctcaaggagcggcttcattggatcagatcaaagaagggtgagctactatgatttcaactttgttggaaatgatgttttcagaatctacagcagggtgatgagcaaccaggtgggcaacttcttcggcgtcggccaaggagatttcttcctggtgaactcagacaacagcaacaccaagaccatcagcttcaccaccagagcaacaaacagcaaccaaagaagcatcttctcccagttccctggagaaaattctgatcctccaacaagcaaggactacagccaccgcctcagctggatctccggcgccttcattggatcagatctggcaaatgtgctgagctatggatggacccaccgctctgttgatccaaacaacaccatctaccctgacaggatcacccaagttcctgctgtcaaggcttcttcagctccagattgcaccgtcatcctcggccctggaagcaccggcggcaacctggtgagctttggaagaagtggccgcctcaacatgcagttcaagttcaccaacatccaaactgagtacagggtgaggatcagatatgcttcaacagctgtcaacaccctcttcgtcagcttctccgactacaacagggacattgctctcaacagcaccggcgcgctctccctcaacaacttgagaaatgagaacttcgcctactttgaagttcctggaggcatcttccggccggcgctgggcaacaccctcatcatctcaaactggacgacggtggcgccgcggctggtgatcgacaagatcgagttcatccccatcaatgcaacaacagcaagatatggaagcaagcaggagctggagaaggccaccaaggtggtgaacaacctcttcatcaac

SEQ ID NO: 195 - DNA, 2007 bp, Artificial Sequence
  synthetic sequence encoding toxin protein
atgaacagctaccaaaacaagaacaagaatgaatatgagatcctggacacctcaagaagcagcagcaccatgtcaacaagatatccaagatatcctcttgctgaaaatcctcagatctccatgcaaaacaccaactacaaggattggatcaacatgtgtgcttcaaggaacctggaagatggcatctaccccacctccgccaatgatgtgatcaccaacagcatcaacatcagcagctacatcctctccatgctggggatgccaaatctctcctccatcattgccatctggggcgtcctcttcaatgccttctggcctgttagtggaaatcaatgggagcactacatgaaccatgttcaagctctcatcaagagggagctacaagcatttgcaagagaacaagctctccgccagctggaaggcctcggcggcaacctcggcctctacaaggaagctcttgctgaatgggagcaggacagggacaaccccaccaccaaggagagggtgagggacaggttcagaatcttggatggcttcttcacccagtacatccctgttttccggatccaaggatatgaggtgcagctgctctcaatctatgccaaggtggtgaacctccatctgctgctgctgagagatgcttccatgttcggcgccgactgggggatgagccaaacaaacatcaatgacaactacaacaggcagatgaagctcaccagcttgtacaccaaccactgcgtggacttctacaaccaaggcctcaatgaagcaagagctctttcaaacagcagctgggacatcttcaatgattacagaagagagatgaccctcaccgtgctggacattgttgctctcttccctgcatatgattacagaagatatcccatcaccaccaaggtggagctgacaagggagatctacacgccggccattgcttcacaaacatggagcaaccacaaccatctctctccaaatgtcaacttccagttctatgaaaacaacctggtgaggccgccggccttcttcacctggctggacagaacagagatgttctcaaggaacctctccattgaagtttcagaagcatggggaggccacatcaaccacttccaccacactggagagcagcctctctcctcaagaagcggcttcattggatcagatcaaagaagggtgagctactatgatttcaactttgttggaaatgatgttttcagaatctacagcagggtgatgagcaaccaagttggcaacttcttcggcgtcggccaaggagatttcttcttggtgaactcagacaacagcaacaccaagaccatcagcttcacaacaagagcaacaaacagcaaccaaagaagcatcttctcccagtttcctggagaaaattctgatcctccaacaagcaaggactacagccaccgcctcagctggatctccggcgccttcattggatcagatcttgcaaatgtgctgagctatggatggacccaccgctctgttgatccaaacaacaccatctatccagacaggatcacccaagttcctgctgtcaaggcttcttcagctccagattgcaccgtcatccttggacctggaagcaccggcggcaacctggtgagctttggaagaagtggaaggctcaacatgcagttcaagttcaccaacatccaaactgaatacagggtgaggatcagatatgcttcaacagctgtcaacaccctcttcgtcagcttctccgactacaacagagacattgctctcaacagcaccggcgcgctctccttgaacaacttgagaaatgaaaacttcgcctactttgaagttcctggaggcatcttccggccggcgctgggcaacaccttgatcatctcaaactggacaacagtggcgccgcggctggtgattgacaagattgagttcatccccatcaatgcaacaacagcaagatatggaagcaagcaggagctggagaaggccaccaaggtggtgaacaacctcttcatcaac

SEQ ID NO: 196 - DNA, 2067 bp, Artificial Sequence
  synthetic sequence encoding toxin protein
atgaaccagaactacaacaacaatgaatatgagatgatgggcaccggcggcatggactaccagccaagatatcctctcaccaatgctcctggatcagagttccagcagatggactacaaggactggatggacatgtgcaccaatgaatctgttggagatgtttttggagacaccgccaatgctgtcagagatggcctcatcatcggcaccggcgtcgcctgggcgctgctggggctgatcccggtggtgggcggcgccgcctcagccattgctggcctcttcaatgtgctgctgccatattggtggcctgaacaagctggagctcctggaactcctcaagctcagttcagctggaaccagctgatgacagctgctgaagagatggtggacaagaagatcctggagagcaagagaggagaagcaacagcaagatggcaaggcatccagctgctgggaagagactactactcagctctctgcgactggattcatgatcaagacaatgctggcaagaaggagaggctcagagatgcttttgatgatctggatgatcagctgaagctggccatgcccttcttctcagttcaaggcttcgagctgccaatgctctccatgtatgctcaagctgccaacatgcacctgctgctgctgagagatgtggtgcaaaatggcgtcagctggggctttgctccatatgaggtggacagatattattttgatccatcaggacaaagaagccctggcctcctccagctgctgggcacctacaccaactactgcgtggaatggtatgagaagggcctccaggagcagtacaacactggaagatgggacaagttcaacaacttcagaaggaacatgaccatcatggtgctggacaccgtcgccatctggccaacatttgatccaagaagatatcctctccccaccaagagccagctaacaaggacgctctacaccaaccctgttggagaaaggctctacagggagaacatggacagcttggagaacaccttggtggcgccgccgcagctcttcacctggctgagggagattgagatccctgttggcatcgtctacctggatgaccgcgcgccgctgctctgcaagcaaaccctccagaggacgctctcaagcaccacctggagcatcacccaaggagagatcaccacgccggtgatcgacaccctcaccctcaccatcgagccgccgcactaccaagatgatgtttggaaggtgaacacccatggcatcagaggaaacaccgacaccgtcaccggctggaccttcaacttcatcaagagcccagatcaaaccttgatggtgtggaacaacattgctcctggatcagtcaccgacagatggagcggcttcccctgccgaggaaatgattctgtcatctgtgatccatgtgattttgagaacacctgccgcaaggagacaccaaacacctccgtgccatgtgatgacaagcagcactacagccaccgcctgagctatgttggagctcaaggagcttcaaggcatggcttcacccccttcgagctgatgtggtttggatatggatggacccatgtctccgccgacaacaatgtgctggatgagaagaagatcacccagatccccgccgtcaagggctaccacaccaatggcgccgtcatcaaggggccaggaagcaccggcggcaacctggtgaagctctcagaaaatgatgatctcaacatcaatgttgctgttcttcctccttctggaagcgcgctggtgtatggctacaacatcaggatcagatatgcttcttctgctgaaacaaggctgctggtggagcaagtttcagaagatcatggaagctacatctacaacatcccctccacctcctccgccgacagcttgacatatcagagcttcagctactatgatcttcccttccacaggattggacctggcattgaagaaacaccaacaagctcaaggctgctcttccagaacagcggcggcggcgacatcatcatcgacaagatcgagttcatccccatcaacactcctggagcagaatatgaagcaaatcaa

SEQ ID NO: 197 - DNA, 2067 bp, Artificial Sequence
  synthetic sequence encoding toxin protein
atgaaccaaaactacaacaacaatgaatatgagatgatgggcactggaggcatggactaccagccaagatatcctctgacaaatgctcctggatcagagttccagcagatggactacaaggattggatggacatgtgcacaaatgaatctgttggagatgtttttggagacacagcaaatgctgtcagagatggcctcatcattggcaccggcgtcgcctgggcgctgctgggcttgattcctgtggtgggcggcgctgcttcagcaattgctggcctcttcaatgtgctgctgccatattggtggcctgaacaagctggagctcctggaactcctcaagctcagttcagctggaaccagctgatgacagctgctgaagaaatggtggacaagaagatcttggagagcaaaagaggagaagcaacagcaagatggcaaggcatccagctgctgggaagagattactattcagctctctgcgactggattcatgatcaagacaatgctggaaagaaggagaggctcagagatgcttttgatgatcttgatgatcagctgaagctggccatgcccttcttctcagttcaaggatttgagctgccaatgctctccatgtatgctcaagctgcaaacatgcatctgctgctgctgagagatgttgttcaaaatggtgtcagctggggatttgctccatatgaggtggacagatattattttgatccatcaggacaaagatctcctggcctcctccagctgctgggcacctacaccaactactgcgtggaatggtatgaaaaaggcctccaggagcagtacaacactggaagatgggacaagttcaacaacttcagaagaaacatgaccatcatggtgctggacaccgtcgccatctggccaacatttgatccaagaagatatcctcttccaaccaagagccagctaacaagaaccttgtacaccaaccctgttggagaaaggctctacagagaaaacatggacagcttggagaacaccttggtggcgccgccgcagctcttcacctggctgagggagattgagattcctgttggcatcgtctacctggatgatagggcgccgctgctctgcaagcaaaccttgcaaaggacgctctcaagcaccacctggagcatcacccaaggagaaatcaccacgccggtgattgacaccttgaccctcaccatcgagcctcctcactaccaagatgatgtttggaaggtgaacacccatggcatcagaggaaacaccgacaccgtcactggatggaccttcaacttcatcaagagcccagatcaaacattgatggtttggaacaacattgctcctggatcagtgacagacagatggagcggcttcccctgccgaggaaatgattctgtcatctgtgatccatgtgattttgaaaacacctgccgcaaggaaacaccaaacacctctgttccatgtgatgacaagcagcactacagccaccgcctgagctatgttggagctcaaggagcttcaaggcatggcttcacccccttcgagctgatgtggtttggatatggatggacacatgtctccgccgacaacaatgtgctggatgagaagaagatcacccagatccctgctgtcaagggctaccacacaaatggagctgtcatcaaaggaccaggaagcactggaggcaacctggtgaagctctcagaaaatgatgatctcaacatcaatgttgctgttcttcctccttctggaagcgcgctggtttatggctacaacatcaggatcagatatgcttcttctgctgaaacaaggctgctggtggagcaagtttcagaagatcatggaagctacatctacaacatcccttccacctcctccgccgacagcttgacatatcagagcttcagctactatgatcttcccttccacaggattggacctggaattgaagaaacaccaacaagctcaaggctgctcttccagaacagcggcggcggcgacatcatcatcgacaagattgagttcatccccatcaacactcctggagcagaatatgaagcaaatcaa

SEQ ID NO: 198 - DNA, 2256 bp, Artificial Sequence
  synthetic sequence encoding toxin protein
atgaccgtccgcctctccgcccacaagctgaagcaatgcatcctcatctatggagagcagatccgcgccatcacctccatccccttcggccgccaccaggtgctgacatatgagatcatgaacttctcagaatggcaagatctctgcggcaatgtttctcctcaaaacaggatcgacattgatccagaaactgctgtcaccgccgccgccggcattggatgggcgctgctgggcatcagcaaccccattgcctccgccgtcgccggcgtcgccaatgtgctgatccccatcctctggccaacagctgctgaagatccaaatgtcatctggaactcattgatggccaaggcagaagctctggtggatgccaagattgatcaagcaatgaaggcgctggccatcagcaagatcaatggcctcaagaatgccatgaatgaatattgccgcgcgctggcaaggctgaaggcagatccaaacaacccaacagagaaggcggtggtgagaggagcatatcaaagcatggacttcctcttcctctactcaatgccgcagtttgctgttccaaacttcgaggtgcagctgctgccaacatatgctgaagctgccaacctccacctcctcttcatcagagatgctgtcaagtttggcaacagctgggacatgacacaagctcaaattgaaggagaatacacagatctgaggaaccacacaagggagtacaccacccactgcgtcaactggttcaacaccggcctaacaaggctggaaacaaagagcgccaacatgacagattgcaagagatatccatgggccacctactaccaatatggctgggaatgtgctctgagcccaaggacctgccccaccatccccctcacctccacctgtgatgagcaaacaaatgaatattatccagaggagaagccagaaacaagaggaactggctacagaggatcagaaggagaatatcaagggctggagaactggaacctctacaatgatttcagaagggacatgaccatcctggtgctggacattgtttctgtttggccaacatatgatccaaggctctaccagctcggcgtcaagagcgagctgacaaggacgctctacacccccatcagaggaacaacatacagatcagatctcaaccagaacacaaggagcgccatcgagaacaggatgatcccccagcctggcctcttcacctggctcacccagctgaagtttgaaaggatcaacatcccctacaatggaacaacatatggatcacagtacactgctggagatctgctgacaggaggaagccagcagaggaagtacaccctctcctccttgagcttcgagaaccagtttggccaaactggcaccctccccatcatcaccgtcaacagcacgccagattcaagcatcaccaagctcatcaccaggcaatggtttgagccaagggagatcgagctctacaaaggaaatgcttctcagttcaccttgggcagcatcgtggagagatgcccctacttgatgggagaaagcggctacaccaagcaggtgatctatgatccaacaagaagggacaacatgatccccaaggccatggaccccaacaacccttcagctcctgcttctcaatggaaggacagccaccgcctcagctacttcaaatatgaacctctccgcgccaactctccatttggatatccagatcgaggccagataggagctgtgctgtttggatggacccacatgctggtggaccccaacaacaccatcagcagcgaccagatcacaaggattcctgctgtcaagggctacaacagaagcacagatgcttcaatcattgaaggacctggctgcactggaggaaatgttgcttccttgaggagcagggtgacaccagaaggaagcatcttccaaggcgtcatcctcatcagggtcaccggcgtcaccgccaaggcctacagggtgaggatcagatatgctgcttctcaaagcatcaccttgatctttgaaagatacagaagcagcaccggcgccgccgagttctcaaggcaagaaaccctctctccaacatattctggcaccttgacctgcaacagctttggctaccacaccatcaacagcttgctgccagcaactgatttcaccctctgggagctccagatcaagaacaggacaaatgccaacaccaccatcatcatcgacaagatcgagttcatccccatcaacaccaccttggaagaatatgaagcaaatcaa

SEQ ID NO: 199 - DNA, 2256 bp, Artificial Sequence
  synthetic sequence encoding toxin protein
atgaccgtccgcctctctgctcacaagctgaagcaatgcatcctcatctatggagagcagatccgcgccatcacctccatccccttcggccgccaccaggtgctgacatatgagatcatgaacttctcagaatggcaagatctctgtggaaatgtttctcctcaaaacaggattgacattgatccagaaactgctgtcaccgccgccgccggcattggatgggcgctgctgggcatcagcaaccccattgcttccgccgtcgccggcgtcgccaatgtgctgatccccatcctctggccaacagctgctgaagatccaaatgtcatctggaactcattgatggccaaggcagaagctctggtggatgcaaagattgatcaagcaatgaaggcgctggccatcagcaagatcaatggcctcaagaatgccatgaatgaatattgccgcgcgctggcaaggctgaaggcagatccaaacaacccaacagagaaggctgtggtgagaggagcatatcaaagcatggacttcctcttcctctattcaatgcctcaatttgctgttccaaattttgaggtgcagctgctgccaacatatgctgaagctgcaaacctccacctcctcttcatcagagatgctgtcaagtttggaaacagctgggacatgacacaagctcaaattgaaggagaatacacagatctgaggaaccacacaagggagtacaccacccactgcgtcaactggttcaacactgggctaacaaggctggaaacaaagagcgccaacatgacagattgcaaaagatatccatgggccacctactaccaatatggatgggaatgtgctctgagcccaagaacctgccccaccatccctctcacctccacctgtgatgaacaaacaaatgaatattatccagaagagaagccagaaacaagaggaactggctacagaggatcagaaggagaatatcaagggctggagaactggaacctctacaatgatttcagaagagacatgaccatcttggtgctggacattgtttctgtttggccaacatatgatccaaggctctaccagctcggcgtcaagagcgagctgacaagaaccttgtacacccccatcagaggaacaacatacagatcagatctcaaccagaacacaagaagcgccatcgagaacaggatgattcctcaacctggcctcttcacctggctcacccagctgaagtttgaaaggatcaacatcccctacaatggaacaacatatggatcacaatacactgctggagatctgctgacaggaggaagccagcaaaggaagtacaccctctcctccttgagctttgagaaccagtttggacaaactggaaccctccccatcatcaccgtcaacagcacaccagattcaagcatcaccaagctcatcacaaggcaatggtttgaaccaagggagattgagctctacaaaggaaatgcttctcagttcaccttgggaagcattgtggaaagatgcccctacttgatgggagaaagtggctacaccaagcaggtgatctatgatccaacaagaagagacaacatgatccccaaggccatggaccccaacaatccttcagctcctgcttctcaatggaaggacagccaccgcctcagctacttcaaatatgaacctctccgcgccaactctccatttggatatccagatcgaggccagataggagctgttctctttggatggacccacatgctggtggaccccaacaacaccatcagcagcgaccagatcacaaggattcctgctgtcaagggctacaacagaagcacagatgcttcaatcattgaaggacctggctgcactggaggaaatgttgcttccttgagaagcagggtgacaccagaaggaagcatcttccaaggcgtcatcctcatcagggtcaccggcgtcaccgccaaggcctacagggtgaggatcagatatgctgcttctcaaagcatcaccttgatctttgaaagatacagaagcagcaccggcgccgccgagttctcaaggcaagaaaccctctctccaacatattctggaacattgacctgcaacagctttggctaccacaccatcaacagcttgctgccagcaactgatttcaccctctgggagctccagatcaagaacagaacaaatgcaaacaccaccatcatcatcgacaagattgagttcatccccatcaacaccaccttggaagaatatgaagcaaatcaa

SEQ ID NO: 200 - DNA, 2124 bp, Artificial Sequence
  synthetic sequence encoding toxin protein
atgaaccagaactatgaaaatggagagatggagatcctggagagcaatggcatcaggagcggcttctccatgggcaacatccagaacagcaacatcagcaacatgtcaaacatgagatatgaagaatggcaggacatgtgcggcaccaagaaggaaggagagctcttcagctatgcaacaggaacacaagctgcttctgacataacatgggccatcctccacattggaaatcctgccttctcagaagctggaggcatccaccgcaccatctcccccatcctctggccaacagaaacacaagatcctcaagctgtttggtcaagcctcatcgacagaggagaatatctcctccagaagcccatcgacgccaccttgaagagccaggtgattgctgagatcaatggatttgaaaccctcttcaacagatacaatgacttcctcaacatcttgaagcaaaatcctggagacaccggcctacaagaagctgtccgcctcgccttcaactacatcaacagccagctgctggagaggattccaaagttctccgccaccaactatgaggtgcagctgctgccggtgtacacccagatcaccaacctccacctgctgctgctgagagatgctgccaagtttggcaagagctgggggatgtcagatgctgacatcaacacccaccagagcagcttgacaacacaaacaaggatctacaccgactactgcgtcaggacctacaacaccggcctctcaaacacgccggcgccaaacctcaatgattgcacaagatatccatggctgagatatgatcatccagacatcactgggccggtgccggccaacccctgcactggaagagaaagcagctgtgatgatgagcaaggaaatgaaaatcttccagaagtctcgccgcgcgcctggtacagatcagcaaaagaagaatatgctggaacagaaacatggaacctctacaatgatttcagaagggagatgaccatcatggtgctggacctcattgctctctggccaacatacaaccccctcacctacaacatccccgtcaagcaggagctgacaagggagctctacacctccatccttggaacaacatatcaaacagatcacagccagaacaccatctcagccatcgacaacaggatgacaaggaggcctcatctctttgaatggctcactggagatctcaccgtggatgtccgccagatgaatgccaactggatcagaggctacttccaaacaaaggtgaagcagaggaccaagaggacgctgggcagcaccatcaccgtccatgagagcggcaagcaaggatcagactaccactacttcccaaatgtcaccgccaatgaaagagatttccgcgccttcgacaccaatgtttggtttgagccgcgcctcttcagaatgtacttcgccgacaaatggtactacccttcatgggatgtgaatgtgctggagacagagccatggagcccagaaggaccaaaaacacatgcctaccagcccaccatcagaagcagcatcaaccgccaccgcgtcagcttctggatgtggcagagcgtcagaagcaatgctcccttcacaagatggaatgaaggccagctctccgcgctgaactgggcatggacccatgattcagcagatccaaacaacaccctcgccgccgacaagatcacaaggattcctgctgtcaaggccttccagatcaagcaaggagctcaagtcatcaaggggccaggcttcactggaggagatgtcatcaccatgccaagcagcagccatggagcaaaaacccagattgagatgaatgtcaagccgcagcaaactggcaagccctaccgcgtccgcgtcagatatgcttcacagcagagcggcgagatctttgttggaaaatgggtggagaaatggtttgagaagggctggtacagcatccccgccacctactcaggagagctgacacaaagcagcttcagatatctggacaccatccagttcaccgccaatgaaagccagtttggcatcgacctccaagctggcatcggcggcgccgtcatcatcgacaccgtggagttcatccccctcaacaccaccttggaagaatatgaggtgaaccag

SEQ ID NO: 201 - DNA, 2124 bp, Artificial Sequence
  synthetic sequence encoding toxin protein
atgaaccagaactatgaaaatggagagatggagatcctggagagcaatggcatcaggagcggcttctccatgggcaacatccagaacagcaacatcagcaacatgtcaaacatgagatatgaagaatggcaggacatgtgcggcaccaagaaggaaggagagctcttcagctatgcaacaggaacacaagctgcttctgacataacatgggccatcctccacattggaaatcctgccttctcagaagctggaggcatccaccgcaccatctcccccatcctctggccaacagaaacacaagatcctcaagctgtttggtcaagcctcatcgacagaggagaatatcttcttcagaagcccattgatgccaccttgaagagccaggtgattgctgagatcaatggatttgaaaccctcttcaacagatacaatgatttcctcaacatcttgaagcaaaatcctggagacaccggcctacaagaagctgttcgcctcgccttcaactacatcaacagccagctgctggagaggattccaaagttctccgccaccaactatgaggtgcagctgctgccggtgtacacccagatcaccaacctccatctgctgctgctgagagatgctgcaaaatttggaaaaagctgggggatgtcagatgctgacatcaacacccatcaaagcagcttgacaacacaaacaaggatctacaccgactactgcgtcaggacatacaacaccggcctctcaaacacgccggcgccaaacctcaatgattgcacaagatatccatggctgagatatgatcatccagacatcactgggccggtgccggccaacccctgcactggaagagaaagcagctgtgatgatgaacaaggaaatgaaaatcttccagaagtttctccgcgcgcctggtacagatcagcaaaagaagaatatgctggaacagaaacatggaacctctacaatgatttcagaagagagatgaccatcatggtgctggacctcattgctctctggccaacatacaaccctctcacctacaacatccctgtgaagcaggagctgacaagggagctctacacctccatccttggaacaacatatcaaacagatcacagccaaaacaccatctcagccatcgacaacaggatgacaagaaggcctcatctctttgaatggctcactggagatctcaccgtggatgttcgccagatgaatgcaaactggatcagaggatacttccaaacaaaggtgaagcagaggacaaaaaggacgctgggaagcaccatcaccgtccatgaaagcggcaagcaaggatcagattaccactacttcccaaatgtcaccgccaatgaaagagatttccgcgccttcgacaccaatgtttggtttgagccaaggctcttcagaatgtacttcgccgacaaatggtactatccttcatgggatgtgaatgtgctggaaacagaaccatggagcccagaaggaccaaaaacacatgcctaccagccaaccatcagaagcagcatcaacaggcaccgcgtcagcttctggatgtggcagagcgtcagaagcaatgctcccttcacaagatggaatgaaggccagctctccgcgctgaactgggcatggacacatgattcagcagatccaaacaacaccctcgccgccgacaagatcacaaggattcctgctgtcaaggccttccagatcaagcaaggagctcaagtcatcaaaggaccaggcttcactggaggagatgtcatcaccatgccaagcagcagccatggagcaaaaacacaaattgagatgaatgtcaagcctcagcaaactggaaagccatacagggtccgcgtcagatatgcttcacagcagagcggcgagatctttgttggaaaatgggtggagaaatggtttgagaaaggatggtacagcatccccgccacctactcaggagagctgacacaaagcagcttcagatatctggacaccatccagttcaccgccaatgaaagccaatttggcatcgacctccaagctggcatcggcggcgccgtcatcatcgacaccgtggagttcatccctctcaacaccaccttggaagaatatgaggtgaaccaa

SEQ ID NO: 202 - DNA, 2013 bp, Artificial Sequence
  synthetic sequence encoding toxin protein
atgagatatgaagaatggcaggacatgtgcggcaccaagaaggaaggagagctcttcagctatgccaccggcacccaagctgcttctgacataacatgggccatcctccacattggaaatcctgccttctcagaagctggaggcatccaccgcaccatctcccccatcctctggccaacagaaacacaagatcctcaagctgtttggtcaagcctcatcgacagaggagaatatctcctccagaagcccatcgacgccaccttgaagagccaggtgattgctgagatcaatggatttgaaaccctcttcaacagatacaatgacttcctcaacatcctcaagcaaaatcctggagacaccggcctacaagaagctgtgaggctggccttcaactacatcaacagccagctgctggagaggattccaaagttctccgccaccaactatgaggtgcagctgctgccggtgtacacccagatcaccaacctccacctgctgctgctgagagatgctgccaagtttggcaagagctgggggatgagcgacgccgacatcaacacccaccagagcagcttaacaacacaaacaaggatctacaccgactactgcgtcaggacctacaacaccggcctctcaaacacgccggcgccaaacctcaatgattgcacaagatatccatggctgagatatgatcatccagacatcaccggccctgttccagcaaatccatgcactggaagagaaagcagctgtgatgatgagcaaggaaatgaaaatcttccagaagtttctccaagagcttggtacagatcagcaaaagaagaatatgctggaacagaaacatggaacctctacaatgatttcagaagggagatgaccatcatggtgctggacctcattgctctctggccaacatacaaccccctcacctacaacatccccgtcaagcaggagctgacaagggagctctacacctccatccttggaacaacatatcaaacagatcacagccagaacaccatctcagccatcgacaacaggatgacaaggaggcctcatctctttgaatggctcactggagatctcaccgtggatgtccgccagatgaatgccaactggatcagaggctacttccaaacaaaggtgaagcagaggaccaagaggacgctgggcagcaccatcaccgtccatgaatcagggaagcaaggaagcgactaccactacttcccaaatgtcaccgccaatgaaagagatttccgcgccttcgacaccaatgtttggtttgagccgcgcctcttcagaatgtacttcgccgacaaatggtactacccaagctgggatgtgaatgtgctggagacagagccatggtcaccagaaggaccaaaaacacatgcctaccagcccaccatcagaagcagcatcaaccgccaccgcgtcagcttctggatgtggcagagcgtcagatcaaatgctcccttcacaagatggaatgaaggccagctctccgcgctgaactgggcatggacccatgattctgctgatccaaacaacaccctcgccgccgacaagatcacaaggattcctgctgtcaaggccttccagatcaagcaaggagctcaagtcatcaaggggccaggcttcactggaggagatgtcatcaccatgccatcaagcagccatggcgccaagacccagattgagatgaatgtcaagccgcagcaaactggcaagccctacagggtgagggtgagatatgcaagccagcaaagtggagagatctttgttggaaaatgggtggagaaatggtttgagaagggctggtacagcatcccagcaacatattcaggagagctgactcaaagcagcttcagatatctggacaccatccagttcaccgccaatgaaagccagtttggcatcgacctccaagctggcatcggcggcgccgtcatcatcgacaccgtggagttcatccccctcaacaccaccttggaagaatatgaggtgaaccag

SEQ ID NO: 203 - DNA, 2013 bp, Artificial Sequence
  synthetic sequence encoding toxin protein
atgagatatgaagaatggcaggacatgtgcggcaccaagaaggaaggagagctcttcagctatgcaactggcacccaagctgcttctgacataacatgggccatcctccacattggaaatcctgccttctcagaagctggaggcatccaccgcaccatctcccccatcctctggccaacagaaacacaagatcctcaagctgtttggtcaagcctcatcgacagaggagaatatctcctccagaagcccattgatgccaccttgaagagccaggtgattgctgagatcaatggatttgaaaccctcttcaacagatacaatgatttcctcaacatcttgaagcaaaatcctggagacaccggcctacaagaagctgtgaggctggccttcaactacatcaacagccagctgctggagaggattccaaagttctccgccaccaactatgaggtgcagctgctgccggtgtacacccagatcaccaacctccatctgctgctgctgagagatgctgcaaaatttggaaaaagctgggggatgagcgacgccgacatcaacacccatcaaagcagcttaacaacacaaacaaggatctacaccgactactgcgtcaggacatacaacaccggcctctcaaacacgccggcgccaaacctcaatgattgcacaagatatccatggctgagatatgatcatccagacatcactggacctgttccagcaaatccatgcactggaagagaaagcagctgtgatgatgaacaaggaaatgaaaatcttccagaagtttctccaagagcttggtacagatcagcaaaagaagaatatgctggaacagaaacatggaacctctacaatgatttcagaagagagatgaccatcatggtgctggacctcattgctctctggccaacatacaaccctctcacctacaacatccctgtgaagcaggagctgacaagggagctctacacctccatccttggaacaacatatcaaacagatcacagccaaaacaccatctcagccatcgacaacaggatgacaagaaggcctcatctctttgaatggctcactggagatctcaccgtggatgttcgccagatgaatgcaaactggatcagaggctacttccaaacaaaggtgaagcagaggacaaaaaggacgctgggaagcaccatcaccgtccatgaatcaggaaagcaaggaagcgactaccactacttcccaaatgtcaccgccaatgaaagagatttccgcgccttcgacaccaatgtttggtttgagccgcgcctcttcagaatgtacttcgccgacaaatggtactacccaagctgggatgtgaatgtgctggaaacagaaccatggtcaccagaaggaccaaaaacacatgcctaccagccaaccatcagaagcagcatcaacaggcaccgcgtcagcttctggatgtggcagagcgtcagatcaaatgctcccttcacaagatggaatgaaggccagctctccgcgctgaactgggcatggacacatgattctgctgatccaaacaacaccctcgccgccgacaagatcacaaggattcctgctgtcaaggccttccagatcaagcaaggagctcaagtcatcaaggggccaggcttcactggaggagatgtcatcaccatgccatcaagcagccatggagcaaagacccagattgagatgaatgtcaagccgcagcaaactggaaagccctacagggtgagggtgagatatgcttctcagcaaagtggagagatctttgttggaaaatgggtggagaaatggtttgagaaaggatggtacagcatcccagcaacatattcaggagagctgactcaaagcagcttcagatatctggacaccatccagttcaccgccaatgaaagccagtttggcatcgacctccaagctggcatcggcggcgccgtcatcatcgacaccgtggagttcatccctctcaacaccaccttggaagaatatgaggtgaaccaa

SEQ ID NO: 204 - DNA, 2160 bp, Artificial Sequence
  synthetic sequence encoding toxin protein
atgaaccagaactatggaagcaatgaggtggagatcctcaacagcaggaacatgagctgccagccaagatatcccttcgccaaggctcctggatcagagttccagcagatgaactacaaggactggatggacatgtacaacaatgaaagccaagccttcatgggagaaagatacaacagcagcatcagggacagcatcatcacctccaccaacatcattgcctacctcctctcagtgagcttccccggcgccggcgccgccgtcggcatcatcggcgcgctgctggggctgctctggccaacaaacagccaaacagtttgggaggccttcatgaatgctgttgagagcttgatcaaccagaggattcaagacaccgtcagggagaaggccattgctgagctggaaggcctccaaaatgtgctggagctctaccaagaagcatttgatgattggtcagaaaatccaagccagcagaacagatacagggtgctgacagagttccgcggcgccaacaggaccttcgaggccgccatgccatcattcagatttggagatttcaaggtggagctgctcaccgtctatgctcaagctgccaacctccacctgctgctgctctctgaaggagtgaagtttggaagagattgggggatgagcagccttcctggagaagaatggagcgacatctactcaaggctgcaaagaagaacacaagaatacaccgactactgcgtcaccacctacaatgaaggcttcgacaaggccaagatgctggtggccaacctctgcgacctgaacagatatccatgggacagatacaaccaggagttcagagcttcagatcatccaaactgcggcgccaggagcttgtacattggagatcagctccagcatgaatgcaatgagcagatgaacctctacagagcttccatcaggaggagcttggatgagtacagagggctggagaactggaacctcttcaatgccttcagaagggacatgaccatcatggtgctggacatcgtcgccatgtggccaacatatgattcagtgctctatgacaacccatatggcatcaagagcgagatcaccagggaggtgtacaccgacatcagaggaacaacatacagatcagacaacagccagaacaccatcgtcgccattgaaggaaggatgatcccccagccgcgcctcttcagatggctcaaccagttcagattctactggaggaggctgagcggcgactacaccgccggccagatcatcaccggcctccagatcaccgtccaaacaacccttggatcatctgaaaccctgccgctggctggatatggaggaacaagcaccaccacctggcatccaagctatggcatcacctggatcgacaccaagcaatggtttgagccaagatggatgaggttctggagcggctcatatgatgctggatggacagatcatggaactgttggcaccatcgaggagaagcatcccttctgggctgctgggccgcagcaatatgtctacaacccaagccagcgcgccaatgagatccccaagcaccgcctctcatggatgaaatatgagcccatcagaagcaactctccatttggatggacagagtaccagcagctcggcgcgctcaccttgggctggacctacaacagcgtcgaccccaacaacaccatctcctcagacaagatcacccagatccccgccgtcaaaggaaatgctgttgacaatggagcaacagtggtgcgcggccctggaagcactggaggagatctggtgaagctgccggcctacaaccagcaaggaacccagctccgcgtcaaggtgcggccaagcaccacagcaaggacaagaagatacaatgtgaggatcagatatgcttcagaagcaaatgccaacctctttgttggaaaatatgttgatgctgccaacagatggtatgaaactggaaactatgctgtcaaccaaaccttctcaggaagcatgacctacaatgccttcaagtacctggacaccatcagcttcctcgccaatgaagaagagttcaagatcgagctgcgctgcaacagcggcggccccatctacatcgacaagatcgagttcatccctgtttctccaattggagaaggagaaattccagagccgccggcgccg

SEQ ID NO: 205 - DNA, 2160 bp, Artificial Sequence
  synthetic sequence encoding toxin protein
atgaaccaaaattatggaagcaatgaggtggagatcctcaacagcaggaacatgagctgccagccaagatatccatttgccaaagctcctggatcagagttccagcagatgaactacaaggattggatggacatgtacaacaatgaaagccaagccttcatgggagaaagatacaacagcagcatcagagacagcatcatcacctccaccaacatcattgcctacctcctctcagtttccttccccggcgccggcgccgccgtcggcatcatcggcgcgctgctggggctgctctggccaacaaacagccaaacagtttgggaggccttcatgaatgctgttgagagcttgatcaaccaaaggattcaagacaccgtcagggagaaggccattgctgagctggaaggcctccaaaatgtgctggagctctaccaagaagcatttgatgattggtcagaaaatccttctcagcagaacagatacagggtgctgacagagttccgcggcgccaacagaacatttgaggctgccatgccatcattcagatttggagatttcaaggtggagctgctcaccgtctatgctcaagctgcaaacctccatctgctgctgctctctgaaggagtgaagtttggaagagattgggggatgagctctcttcctggagaagaatggagcgacatctattcaaggctgcaaagaagaacacaagaatacacagattactgcgtcaccacctacaatgaaggatttgacaaggccaagatgctggtggccaacctctgtgatctgaacagatatccatgggacagatacaaccaagagttcagagcttcagatcatccaaactgcggcgccaggagcttgtacattggagatcagctgcaacatgaatgcaatgagcagatgaacctctacagagcttccatcagaaggagcttggatgaatacagagggctggagaactggaacctcttcaatgccttcagaagagacatgaccatcatggtgctggacatcgtcgccatgtggccaacatatgattcagttctttatgacaatccatatggcatcaagagcgagatcacaagggaggtgtacaccgacatcagaggaacaacatacagatcagacaacagccaaaacaccatcgtcgccattgaaggaaggatgattcctcagccaaggctcttcagatggctcaaccagttcagattctactggagaaggctgagcggcgactacaccgccggccagatcatcaccggcctccagatcactgttcaaacaactcttggatcatctgaaacattgcctcttgctggatatggaggaacaagcaccaccacctggcatccaagctatggcatcacctggattgacaccaagcaatggtttgaaccaagatggatgaggttctggagcggctcatatgatgctggatggacagatcatggaactgttggaaccatcgaggagaagcatcccttctgggctgctgggccgcagcaatatgtctacaatccaagccagcgcgccaatgagatccccaagcaccgcctctcatggatgaaatatgaacccatcagaagcaattctccatttggatggacagaataccagcagctcggcgcgctcaccttgggatggacctacaacagcgtcgaccccaacaacaccatctcttcagacaagatcacccagatccctgctgtcaaaggaaatgctgttgacaatggagcaacagtggtgcgcggccctggaagcactggaggagatctggtgaagctgccggcctacaaccagcaaggaacacagctccgcgtcaaggtgaggccaagcacaacagcaagaacaagaagatacaatgtgaggatcagatatgcttcagaagcaaatgcaaacctctttgttggaaaatatgttgatgctgcaaacagatggtatgaaactggaaattatgctgtcaaccaaaccttctcaggaagcatgacatacaatgccttcaagtacctggacaccatcagcttcttggcaaatgaagaagagttcaagattgagctgcgctgcaacagcggcggccccatctacatcgacaagattgagttcatccctgtttctccaattggagaaggagaaattccagagccgccggcgccg

SEQ ID NO: 206 - DNA, 1992 bp, Artificial Sequence
  synthetic sequence encoding toxin protein
atgaacaggaacaaccaaaatgaatgtgagatcattgatgctcctcattgtggctgcccttctgatgatgtggtgaaatatcctcttgcttcagatccaaatgctgctctccagaacatgaactacaaggactacctccaaacatatgatggagactacaccgacagcttgatcaaccccaacctctccatcaacacaagagatgtgctgcaaactggcatcaccattgttggaaggatcttgggcttcctcggcgtccccttcgccggccagctggtgaccttctacaccttcctcctcaaccagctatggccaacaaatgacaatgctgtttgggaggccttcatggagcagattgaaggcatcattgctcaaaggatctccgagcaggtggtgagaaatgctctggatgctctcaccggcatccatgactactacgaggagtacctcgccgcgctggaagaatggctggagaggccatcaggagcaagggccaacctcgccttccaaagatttgagaacctccaccagctcttcgtgagccagatgccctccttcggcagcggccctggatcagaaagagatgctgtggcgctgctcaccgtctatgctcaagctgccaacctccacctgctgctgctgaaggatgctgagatctatggagcaagatggggcctccagcaaggccagatcaacctctacttcaatgctcagcaggacaggacaaggatctacaccaaccactgcgtcgccacctacaacagaggccttggagatctccgcggcaccaacactgaatcatggctgaactaccaccagttcagaagggagatgaccttgatggccatggatctggtggcgctcttcccctactacaacctccgccaatatccaaatggagctaatcctcagctgacaagagatgtctacacagatcccatcgtgttcaacccttctgcaaatgttggcctctgccggagatggggcaacaacccctacaacaccttctcagagctggagaatgccttcatcaggccgccgcacttcttcgaccgcctcaacagcctcaccatcagcaggaacagatttgatgttggaagcaacttcatcgagccatggagcggccacaccttgaggaggagcttcctcaacacctctgctgttcaagaagattcatatggccagatcaccaaccagaggaccaccatcaaccttccagcaaatggaactggaagagttgaaagcaccgccgtggacttcagatctgctctggtgggcatctatggagtgaacagagcttccttcatccccggcggcgtgttcaatggcaccacccagccaagcaccggcggctgccgagatctctatgattcttcagatgagctgccgccagaagaaagcagcggcaccttcgagcaccgcctcagccatgtcaccttcttgagcttcaccaccaaccaagctggaagcattgcaaatgctggaagggtgccaacatatgtttggacccacagagatgttgatctaaacaacaccatcaccgccgacaggatcacccatcttcctctcatcaagagcaatgttcaaagaagtggccgcgccgtcaaggggccaggcttcactggaggagatgtgctgaggatgagctcttcagatgctgacatctccatcatcggcatcaccgccggcgctcctctcacccagcagtacaggatcaggctgcgctatgcaagcaatgttgatgtcaccatcaggctggtgaggcaggacacccaaagcaacattggaagcatcaacctcctccgcaccatgaactcaggagaagaaagcagatatgaaagctacaggacggtggagatgccaggaaacttcagaatgacaagcagctcggcgcagatccgcctcttcacccaaggcctccgcgtcaatggagagctcttcctggacagcttggagttcatccccgtcaacccaacaagagaagcagaagaa

SEQ ID NO: 207 - DNA, 1992 bp, Artificial Sequence
  synthetic sequence encoding toxin protein
atgaacagaaacaaccaaaatgaatgtgaaatcattgatgctcctcattgtggctgcccttctgatgatgtggtgaaatatcctcttgcttcagatccaaatgctgctcttcaaaacatgaactacaaggactaccttcaaacatatgatggagattacacagacagcttgatcaaccccaacctctccatcaacacaagagatgttcttcaaactggcatcaccattgttggaaggattcttggcttcctcggcgtccccttcgccggccagctggtgaccttctacaccttcctcctcaaccagctatggccaacaaatgacaatgctgtttgggaggccttcatggagcagattgaaggcatcattgctcaaaggatttcagagcaggtggtgagaaatgctcttgatgctctcactggcatccatgattactatgaagagtacctcgccgcgctggaagaatggctggagaggccatcaggagcaagagcaaacctcgccttccaaagatttgaaaacctccaccagctctttgtgagccagatgccatcctttggaagcggccctggatcagaaagagatgctgttgctctgctcaccgtctatgctcaagctgcaaacctccatctgctgctgctgaaggatgctgagatctatggagcaagatggggcctccagcaaggacagatcaacctctacttcaatgctcaacaagacagaacaaggatctacaccaaccactgcgtcgccacctacaacagaggccttggagatctccgcggcaccaacactgaatcatggctgaactaccatcagttcagaagagagatgacattgatggccatggatctggtggcgctcttcccctactacaacctccgccaatatccaaatggagctaatcctcagctgacaagagatgtctacacagatcccattgttttcaatccttctgcaaatgttggcctctgccggagatggggaaacaacccctacaacaccttctcagagctggaaaatgccttcatcaggccgccgcacttcttcgaccgcctcaacagcctcaccatctcaagaaacagatttgatgttggaagcaacttcatcgagccatggagcggccacaccttgagaaggagcttcctcaacacttctgctgttcaagaagattcatatggccagatcaccaaccaaagaacaaccatcaaccttccagcaaatggaactggaagagttgaaagcaccgccgtggacttcagatctgctctggtgggcatctatggagtgaacagagcttccttcatccccggcggcgtgttcaatggaacaacccagccaagcactggaggctgccgagatctttatgattcttcagatgagcttcctccagaagaaagctctggcaccttcgagcaccgcctcagccatgtcaccttcttgagcttcaccaccaaccaagctggaagcattgcaaatgctggaagagttccaacatatgtttggacacatcgagatgttgatctaaacaacaccatcaccgccgacaggatcacccatcttcctctcatcaagagcaatgttcaaagaagtggccgcgccgtcaaaggaccaggcttcactggaggagatgtgctgaggatgagctcttcagatgctgacatctccatcattggcatcaccgccggcgctcctctcacccagcagtacaggatcaggctgcgctatgcttcaaatgttgatgtcaccatcaggctggtgaggcaagacacacaaagcaacattggaagcatcaacctcctgaggaccatgaactcaggagaagaaagcagatatgaaagctacaggacagtggagatgccaggaaacttcagaatgacaagcagctctgctcagatcaggctcttcacccaaggcctccgcgtcaatggagagctcttcttggacagcttggagttcatccctgtcaatccaacaagagaagcagaagaa

SEQ ID NO: 208 - DNA, 1995 bp, Artificial Sequence
  synthetic sequence encoding toxin protein
atgaactgcggcaaccacaatgaatttgacagcattgatgaaacagagaacaaccaaacaacaacaagcagatatgtcaatgtcaccaacaaggtcaccaagcaaggaaacagcagcaacaagatcctctccaacctctcaagcaactacccgctggccagcaaccccaacacccccttccagaacatgaactacaaggagtacctcaacatcattgaaggaaacaccgtcatctcccccaccgtcggcgtcgcctcagctctcaccgccggcgtcaccatcctcaacaagatcctcggcaccctgctgaagaagtttgctggcaagatcctggtgaacatcttcaagctgctctggccaacagcagaaacagatgatgtttgggaggacttcatggaggaggtggagatcctcatcgaccagaagattgaagcatatgcaaaatcaagggcgctgacagatctggtgagcattggaaatgctgtggagagatatcaaacagctctggaggactgggagaagcagccagagaacctcaagagcttggggctggtgatccaaagatacaatgaagcagaaagccatgcaagaaattcaatgccgctctttgctgttggaggcttcgaggtgccgctgctggcaacatatgtcaatgctgcaaatgttcatcttctactgatgagggacatgcagctctatggaaatcaatggggcatcccccagagcgacatcgacctctaccagagggagcaggagaagtacacagatgagtacaccaactactgcgtcaaatggtatgaagaagggctgaagctgctggacccaagggagaactcaagcctccagagcttcgcctaccaatgggagttctacaacagatacaggagggagatgaccttgatggtgctggacctcatctccgtctttccaagctacaatgctgtgctgtaccccattggaacaacagtgaagatcaccagggaggtgtacacagatgtgatggcatatgatgaatggtatccagaggaggtggtgagcagcttcacagattttgaatcaatcctcatcaggcctcctcatctctatgatctgctggagaggatcgacttctacaccaatgttcaaggagacagctacagatgggctggccacaagatcacctacaagagaggaccatatgaaacagctcacaccaagagctatggagacaccgccggcacgccgacggacatctactttggatattcagatgtggtgagcaccatcaccaaggcaacaaggacagtttatggagtggtgaagagcaccttctaccaggtgaatggagagaagagagaatatgatgccaacagcgtcggcaactacagagaagctatctatgacagcaacaatgagctgccgctgggaacatcaggaaacctggatgatgacagaagccacaagctctgccatgctgtgctgtacaagaaggacaagagcccaacagcatatgtgatctacagctggacccatgcttcagctggaaggatcaatgaagtttttggagacaagatcagccagctgccggcggtgaagatgtatgatcttggaggaagcaccaccgtggtgaagggccccaagttcactggaggagatctggtgaagaggaaggcctcctccggcggcggcgtgctgggctactacaaatgcaatgttgcttcttctgatgctcagaagtacaggctgaggatcagatattgctcagatttctccggcatcttcagaatgcaagtcaatggagtggaaaccatccaagctgactacagcagcacaagagattcaacaagcaccatgagctcagagagcttcaagttcagagagttcaccaccaccttcgagctctcagaaggaacaccaagcatcatggtggcgctgggcagcatctatggagaaggagagttctacctggacaggatcgagttcatccctgttgatgtcaactatgatgaaagagtt

SEQ ID NO: 209 - DNA, 1995 bp, Artificial Sequence
  synthetic sequence encoding toxin protein
atgaactgcggcaaccacaatgaatttgacagcattgatgaaacagagaacaaccaaacaacaacaagcagatatgtcaatgtcaccaacaaggtcaccaagcaaggaaacagcagcaacaagatcctctccaacctctcaagcaactacccgctggccagcaaccccaacacccccttccagaacatgaactacaaggagtacctcaacatcattgaaggaaacaccgtcatctcccccaccgtcggcgtcgcctcagctctcaccgccggcgtcaccatcctcaacaagatcctcggcaccttgctgaagaagtttgctggaaagatcctggtgaacatcttcaagctgctctggccaacagcagaaacagatgatgtttgggaggacttcatggaggaggtggagatcctcatcgaccagaagattgaagcatatgcaaaatcaagggcgctgacagatctggtgagcattggaaatgctgtggagagatatcaaacagctctggaggactgggagaagcagccagagaacctcaagagcttggggctggtgatccaaagatacaatgaagcagaaagccatgcaagaaattcaatgccgctctttgctgttggaggcttcgaggtgccgctgctggcaacatatgtcaatgctgcaaatgttcatcttctactgatgagggacatgcagctctatggaaatcaatggggcatcccccagagcgacatcgacctctaccaaagggagcaggagaagtacacagatgagtacaccaactactgcgtcaaatggtatgaagaagggctgaagctgctggacccaagggagaactcaagcctccagagcttcgcctaccaatgggagttctacaacagatacagaagggagatgaccttgatggtgctggacctcatctccgtctttccaagctacaatgctgtgctgtaccccattggaacaacagtgaagatcaccagggaggtgtacacagatgtgatggcatatgatgaatggtatccagaggaggtggtgagcagcttcacagattttgaatcaatcctcatcaggcctcctcatctctatgatctgctggagaggatcgacttctacaccaatgttcaaggagacagctacagatgggctggccacaagatcacctacaagagaggaccatatgaaacagctcacaccaagagctatggagacaccgccggcacgccgacggacatctactttggatattcagatgtggtgagcaccatcaccaaggcaacaagaacagtttatggagtggtgaagagcaccttctaccaggtgaatggagagaagagagaatatgatgccaacagcgtcggcaactacagagaagctatctatgacagcaacaatgagctgccgctgggaacatcaggaaacctggatgatgacagaagccacaagctctgccatgctgtgctgtacaagaaggacaagagcccaacagcatatgtgatctacagctggacccatgcttcagctggaaggatcaatgaagtttttggagacaagatcagccagctgccggcggtgaagatgtatgatcttggaggaagcaccaccgtggtgaagggccccaagttcactggaggagatctggtgaagaggaaggcctcctccggcggcggcgtgctgggctactacaaatgcaatgttgcttcttctgatgctcagaagtacaggctgaggatcagatattgctcagatttctccggcatcttcagaatgcaagtcaatggagtggaaaccatccaagctgactacagcagcacaagagattcaacaagcaccatgagctcagagagcttcaagttcagagagttcaccaccaccttcgagctctcagaaggaacaccaagcatcatggtggcgctgggaagcatctatggagaaggagagttctacctggacaggatcgagttcatccctgttgatgtcaactatgatgaaagagtt

SEQ ID NO: 210 - DNA, 1809 bp, Artificial Sequence
  synthetic sequence encoding toxin protein
atgaactacaaggagtacctcaacatcattgaaggaaacaccgtcatctcccccaccgtcggcgtcgcctcggcgctcaccgccggcgtcaccatcctcaacaagatcctcggcaccctgctgaagaagtttgctggcaagatcctggtgaacatcttcaagctgctatggccaacagcagaaacagatgatgtttgggaggacttcatggaggaggtggagatcctcatcgaccagaagattgaagcatatgcaaaatcaagggcgctgacagatctggtgagcattggaaatgctgtggagagatatcaaacagctctggaggactgggagaagcagccagagaacctcaagagcttggggctggtgatccaaagatacaatgaagcagaaagccatgcaagaaattcaatgccgctctttgctgttggaggcttcgaggtgccgctgctggcaacatatgtcaatgctgcaaatgttcatcttctactgatgagggacatgcagctctatggaaatcaatggggcatcccccagagcgacatcgacctctaccagagggagcaggagaagtacacagatgagtacaccaactactgcgtcaaatggtatgaagaagggctgaagctgctggacccaagggagaactcaagcctccagagcttcgcctaccaatgggagttctacaacagatacaggagggagatgaccttgatggtgctggacctcatctccgtctttccaagctacaatgctgtgctgtaccccattggaacaacagtgaagatcaccagggaggtgtacacagatgtgatggcatatgatgaatggtatccagaggaggtggtgagcagcttcacagattttgaatcaatcctcatcaggccgccgcacctctatgatctgctggagaggatcgacttctacaccaatgttcaaggagacagctacagatgggctggccacaagatcacctacaagagaggaccatatgaaacagctcacaccaagagctatggagacaccgccggcacgccgacggacatctactttggatattcagatgtggtgagcaccatcaccaaggcaacaaggacagtttatggagtggtgaagagcaccttctaccaggtgaatggagagaagagagaatatgatgcaaattcagttggaaactacagagaagctatctatgacagcaacaatgagctgccgctgggcaccagcggcaacctggatgatgacagaagccacaagctctgccatgctgtgctgtacaagaaggacaagagcccaacagcatatgtgatctacagctggacccatgcttctgctggaaggatcaatgaagtttttggagacaagatctcacagctgccggcggtgaagatgtatgatcttggaggaagcaccaccgtggtgaagggccccaagttcactggaggagatctggtgaagaggaaggcctcctccggcggcggcgtgctgggctactacaaatgcaatgttgcttcttctgatgctcagaagtacaggctgaggatcagatattgctcagatttctccggcatcttcagaatgcaagtcaatggagtggaaaccatccaagctgattattcttcaacaagggacagcacctccaccatgagctcagagagcttcaagttcagagagttcaccaccaccttcgagctctcagaaggaacaccaagcatcatggtggcgctgggcagcatctatggagaaggagagttctacctggacaggatcgagttcatccctgttgatgtcaactatgatgaaagagtt

SEQ ID NO: 211 - DNA, 1809 bp, Artificial Sequence
  synthetic sequence encoding toxin protein
atgaactacaaggagtacctcaacatcattgaaggaaacaccgtcatctcccccaccgtcggcgtcgcctcggcgctcaccgccggcgtcaccatcctcaacaagatcctcggcaccttgctgaagaagtttgctggaaagatcctggtgaacatcttcaagctgctatggccaacagcagaaacagatgatgtttgggaggacttcatggaggaggtggagatcctcatcgaccagaagattgaagcatatgcaaaatcaagggcgctgacagatctggtgagcattggaaatgctgtggagagatatcaaacagctctggaggactgggagaagcagccagagaacctcaagagcttggggctggtgatccaaagatacaatgaagcagaaagccatgcaagaaattcaatgccgctctttgctgttggaggcttcgaggtgccgctgctggcaacatatgtcaatgctgcaaatgttcatcttctactgatgagggacatgcagctctatggaaatcaatggggcatcccccagagcgacatcgacctctaccaaagggagcaggagaagtacacagatgaatacaccaactactgcgtcaaatggtatgaagaagggctgaagctgctggacccaagggagaactcaagcctccagagcttcgcctaccaatgggagttctacaacagatacagaagagagatgaccttgatggtgctggacctcatctccgtctttccaagctacaatgctgtgctgtaccccattggaacaacagtgaagatcaccagggaggtgtacacagatgtgatggcatatgatgaatggtatccagaagaggtggtgagcagcttcacagattttgaatcaatcctcatcaggccgccgcacctctatgatctgctggagaggatcgacttctacaccaatgttcaaggagacagctacagatgggctggccacaagatcacctacaagagaggaccatatgaaacagctcacaccaagagctatggagacaccgccggcacgccgacggacatctactttggatattcagatgtggtgagcaccatcaccaaggcaacaagaacagtttatggagtggtgaagagcaccttctaccaggtgaatggagagaagagagaatatgatgcaaattcagttggaaactacagagaagctatctatgacagcaacaatgagctgccgctgggcaccagcggcaacctggatgatgacagaagccacaagctctgccatgctgtgctgtacaagaaggacaagagcccaacagcatatgtgatctacagctggacacatgcttctgctggaaggatcaatgaagtttttggagacaagatctcacagctgccggcggtgaagatgtatgatcttggaggaagcaccaccgtggtgaaggggccaaagttcactggaggagatctggtgaagaggaaggcctcctccggcggcggcgtgctgggctactacaaatgcaatgttgcttcttctgatgctcagaagtacaggctgaggatcagatattgctcagatttctccggcatcttcagaatgcaagtcaatggagtggaaaccatccaagctgattattcttcaacaagggacagcacctccaccatgagctcagagagcttcaagttcagagagttcaccaccaccttcgagctctcagaaggaacaccaagcatcatggtggcgctgggaagcatctatggagaaggagagttctacctggacaggattgagttcatccctgttgatgtcaactatgatgaaagagtt

SEQ ID NO: 212 - DNA, 2043 bp, Artificial Sequence
  synthetic sequence encoding toxin protein
atgaacctcaatgacaacaagaatgaatttgagatcatggatcatggaagcatgggctaccagccaaaatatcctctggccaaggagagcgtgccaactggccagaacatgaactacacagattggatgaacagatgtgcaaatggagaagttgatgtttttggagacacctcaggaagcgtcagaaatgctctgatctatggaactggagttggatgggcgctgctgggcttcatccccgtcattggaggaccagcttcagccattgctggcctcttcaatgtgctgctgccatattggtggcctgaacaagctggagcttctggatctcctcaagctcagtacacctgggcgcagctgatggctggaagcgaggagatcaccgacaagaagatcctggagagcaagaagagcgacgccattgcaagatggcaaggcatccaatcaatgggccgcgtctactatgagaagctctgcgactggattggagatcaaaacaatgaggtgaagaaggaccgcctcagagatgcttttgatgatctggatgacaggatcagggtttcaatgccgcacttccaagctcaaaccttcgaggttcagatgctctccatgtatgctcaagctgccaacatgcacctgctgctgctcagagatgtggtgacaaatggcaccaactggggcttcgagcagtttgaggtggacagatattattcaaatgctgatggccttggaaatcctggcctcctccagctgctgaacagctacaccaactactgcatcgactggtacaacaccggcctccaggagcaatatgacactggagattggaacaagttcaacaacttcagaacaacaatgaccatctcagtgctggacaccgtcgccacctggccaacatttgatccaaagttctacagcctccccaccaagagccagctgacaaggatcgtctacacgccgcgcgtcggcgacacagcaagaagcaacaggccatcagcaagcattgatgctcaagaaaacaacatcgtcagctcgccgcgcctcttcgcctggctgaggatggtggatgtttctctccagaagaatggcctcagcaatgagatcgccagctacaagcagaccttccacaacaccttgaggacaggatcatggagcatcaccaagggcacgccaacaaatgatgtgaggaacatgttcaccatcccctacttcccatatgatgacatctggaagatcaagaatgagttctttgattatggctcgccatttgatgatcttgctgtggacagctggaccttctccttcagatattcagaagatcaatattttgagctctccacatatgacaagagcgtgacaaggttctatggcctcccctgccgcgccaagaactcaggcatctgtgatccatgtgacagccaaaatccatgccgcaaagagctgccaaacactacaatgccatgtgaggacaagaggctctacagccaccgcctcgcctacatgggagctggagaaaatgtctacccgccgccgagcttgacctacagcgcctatggatggacccatgtttcagctgatgctgacaacaggattgatgctgagaagatcacccagatccccgccgtcaaaggaaatgagctggaaggaggaactgtcatcaaggggccaggaagcaccggcggcaacctcatccagctggacagctatggcaacaggatcgtgctgcccatcaagctgcctgtcaccacccaagcatacagggtgaggatcagatatgcttcaaatgctgtgctctccatcagggtttctcttgatggagatgtggtgctgggcaccttcattgctcctgccaccaccagcgacctcaccaagctcacctacaacaccttcgcctacctggacacctccgtgctgacagcagaaagatcaacaaggctgatgttcatcagccacaatgatctgaggaacagcaggaccttcatcatcgacaagatcgagttcatccccattgaaggatctgctgctgaatatgaagcaagccaa

SEQ ID NO: 213 - DNA, 2043 bp, Artificial Sequence
  synthetic sequence encoding toxin protein
atgaacctcaatgacaacaagaatgaatttgagatcatggatcatggaagcatgggctaccagccaaaatatcctctggccaaggagagcgtgccaactggacaaaacatgaactacacagattggatgaacagatgtgcaaatggagaagttgatgtttttggagacacctcaggaagcgtcagaaatgctctgatctatggaactggagttggatgggcgctgctgggcttcatccctgtcattggaggaccagcttcagcaattgctggcctcttcaatgtgctgctgccatattggtggcctgaacaagctggagcttctggatctcctcaagctcagtacacctgggcgcagctgatggctggatcagaggagatcaccgacaagaagatcctggagagcaagaagagcgacgccattgcaagatggcaaggcatccaatcaatgggccgcgtctactatgagaagctctgcgactggattggagatcaaaacaatgaggtgaagaaggacaggctcagagatgcttttgatgatcttgatgacaggatcagagtttcaatgcctcacttccaagctcaaacatttgaagttcagatgctctccatgtatgctcaagctgccaacatgcatctgctgctgctcagagatgtggtgacaaatggaacaaactggggcttcgagcagtttgaggtggacagatattattcaaatgctgatggccttggaaatcctggcctcctccagctgctgaacagctacaccaactactgcattgattggtacaacaccggcctccaggagcaatatgacactggagattggaacaagttcaacaacttcagaacaacaatgaccatctcagtgctggacaccgtcgccacctggccaacatttgatccaaagttctacagcctccccaccaagagccagctgacaaggatcgtctacacgccgcgcgtcggcgacacagcaagaagcaacaggccatcagcaagcattgatgctcaagaaaacaacatcgtcagctcgccgcgcctcttcgcctggctgaggatggtggatgtttctctccagaagaatggcctcagcaatgagattgcaagctacaagcaaaccttccacaacaccttgaggacaggatcatggagcatcaccaagggaacaccaacaaatgatgtgaggaacatgttcaccatcccctacttcccatatgatgacatctggaagatcaagaatgagttctttgattatggatctccatttgatgatcttgctgtggacagctggaccttctccttcagatattcagaagatcaatattttgagctctcaacatatgacaagagcgtgacaaggttctatggcctcccctgccgcgccaagaactcaggcatctgtgatccatgtgacagccaaaatccatgccgcaaagagctgccaaacactacaatgccatgtgaggacaagaggctctacagccaccgcctcgcctacatgggagctggagaaaatgtctacccgccgccgagcttgacatacagcgcctatggatggacacatgtttcagctgatgctgacaacaggattgatgctgagaagatcacccagatccctgctgtcaaaggaaatgagctggaaggaggaactgtcatcaaggggccaggaagcaccggcggcaacctcatccagctggacagctatggcaacaggattgtgctgcccatcaagctgcctgtcaccacccaagcatacagggtgaggatcagatatgcttcaaatgctgttctctccatcagagtttctcttgatggagatgtggtgctgggcaccttcattgctcctgccaccaccagcgacctcaccaagctcacctacaacaccttcgcctacctggacacctccgtgctgacagcagaaagatcaacaaggctgatgttcatcagccacaatgatctgaggaacagcaggaccttcatcatcgacaagattgagttcatccccattgaaggatctgctgctgaatatgaagcaagccaa

SEQ ID NO: 214 - DNA, 2043 bp, Artificial Sequence
  synthetic sequence encoding toxin protein
atgaaccagaactacaacaaccatgaatatgagatcaaggatgctggcatcattgatgatcagccaagatatcctcttgctcaagctccttctgctgaggtgcagcagatgagctacaagggctggatggacagatgcaccaatgaagaatcagaagctctcttcaccgacatcaccgtcaaggatgctgtcaccattgccacctccatcaccgccgccgtgctgggcatcagcttccctctctccgccgccaccgcctccattgtttcagtgctgatcccctactggtggcctgctgctgctggaactcctggaagcacccaagctcagatcacctgggagaggctgatgtctgctgttgagaagctctccaaccagaagatccaggacagcaagagatcagatgccatcagcagatggaagggcattcaagctcttggaagagaatatgcaagagctctctgcgacctcaaggaggagccagacaatgctgctctcaagacaacagtgaggaacaagtttgagagcgtggaggaccagctgaagatctccatgccatacttctctgctgaaggatttgagatccccatgctctcaatgtatgctcaagctgccaacatgcacctgctgctgctgaaggatgtggtgcaaaatggcgtcagctggggctacaggcagattgatgtggacagatactacagcaacacagatcccttccttggaaatcctggcctcctccagctctcagcaacatacacagattattgtgttcaatggtacaacaccggcctccgccagcaatatgccatcaacagcaacaactggaatgttttcaatgccttcagaaggaacatgaccatcatggtgctggacatcgtcagcctctggccaacatatgatccaaaaagatattcactgccaacaaagagccagctgacaaggacggtgtacacagatctgctgggcttctccggccatgatgcatatcctcaaattggcattgaaagagcagagctggagctggtgcagcggcctggcctcttcacctggctgagggagctcaacttcaacctcaagagccagagcttgatcaacttcgtcgccggcatcgagatggacttcgactacaccactgtttcagaaggctacaaggagaaggaaggaagcctcggccaaacaagagaaacagtggtgctgccaagcaagtacagccaagatgacatctggaagatcaccaccagcttgaacctcaaccagatcccaaatgcaaatgctgtcaagggctggatcttctccttcaccaaatcaccagatcagctggtgagctgggggccggcggagagtgatggagacaaggtgcacagcggcctcgcctgcaatggaccttctgtggacagctgcgacctctgcatcattgattctccctgccgctccatcacccccaacaacagcttcccttgtgatgacaagggcgtctacagccaccgcttcagctacctcggcgccggcttcaccccagatgtttcagctctgagcttcttcagctatggatggacccatgtttctgttgatgccaacaacctcatcaacaccggcaacatcacccagatccccgccgtcaagggcagcttctcagaaggaactgtcatcagaggacctggaagcactggaggagatctggtgcagctcttccccagccagctgctgcacctccgcgtcaccatccctgctgatcctctgacaggctacaggatcaggatcagatatgcttcaaaggtgccggcggagattgctgttggcttccagagcagccttggagaacctgatgcaacatatcaagttcctgccacctacacctctggagatctcacctacaacaccttcggctaccagaacaccctctccatccctcctcattcagaagaagagctgatctatgtcatcgtcaacaccgtcaacagcattgattcagaacctgtcatcatcgacaagatcgagttcatccccattgaagaatctgttgctgaatttgaagcaaatcaa

SEQ ID NO: 215 - DNA, 2043 bp, Artificial Sequence
  synthetic sequence encoding toxin protein
atgaaccagaactacaacaaccatgaatatgagatcaaggatgctggcatcattgatgatcaaccaagatatcctcttgctcaagctccttctgctgaggtgcagcagatgagctacaaaggatggatggacagatgcacaaatgaagaatcagaagctctcttcaccgacatcaccgtcaaggatgctgtcaccattgccacctccatcaccgccgccgtgctgggcatcagcttccctctctccgccgccaccgcctccattgtttcagtgctgatcccctactggtggcctgctgctgctggaactcctggaagcacccaagctcagatcacctgggagaggctgatgtctgctgttgagaagctctccaaccagaagatccaggacagcaaaagatcagatgccatctcaagatggaagggcattcaagctcttggaagagaatatgcaagagctctctgcgacctcaaggaggagccagacaatgctgctctcaagacaacagtgaggaacaagtttgaaagcgtggaagatcagctgaagatctccatgccatatttctctgctgaaggatttgagatccccatgctctcaatgtatgctcaagctgcaaacatgcatctgctgctgctgaaggatgttgttcaaaatggcgtcagctggggctacaggcagattgatgtggacagatactacagcaacacagatcccttccttggaaatcctggcctcctccagctctcagcaacatacacagattattgtgttcaatggtacaacaccggcctccgccagcaatatgccatcaacagcaacaactggaatgttttcaatgccttcagaagaaacatgaccatcatggtgctggacatcgtcagcttgtggccaacatatgatccaaaaagatattcacttccaacaaaaagccagctgacaaggacggtgtacacagatctgctgggcttctccggccatgatgcatatcctcaaattggcattgaaagagcagagctggagctggtgcagcggcctggcctcttcacctggctgagggagctcaacttcaacttgaagagccagagcttgatcaacttcgtcgccggcattgagatggattttgactacacaacagtttcagaaggatacaaggagaaggaaggaagcctcggccaaacaagagaaacagtggtgctgccaagcaagtacagccaagatgacatctggaagatcaccaccagcttgaacctcaaccagattccaaatgcaaatgctgtcaaaggatggatcttctccttcaccaaatcaccagatcagctggtgagctgggggccggcagaaagtgatggagacaaggtgcattctggcctcgcctgcaatggaccttctgtggacagctgcgacctctgcatcattgattctccatgccgctccatcacccccaacaacagcttcccttgtgatgacaagggcgtctacagccaccgcttcagctacctcggcgccggcttcactccagatgtttcagctctgagcttcttcagctatggatggacacatgtttctgttgatgcaaacaacctcatcaacactggaaacatcacccagatccctgctgtcaagggcagcttctcagaaggaactgtcatcagaggacctggaagcactggaggagatctggtgcagctcttcccaagccagctgctgcatctccgcgtcaccatccctgctgatcctctgacaggctacaggatcaggatcagatatgcttcaaaggtgccagcagagattgctgttggcttccaaagctctcttggagaacctgatgcaacatatcaagttccagcaacatacacttctggagatctcacctacaacacctttggctaccaaaacaccctctccatccctcctcattcagaagaagagctgatctatgtcatcgtcaacaccgtcaacagcattgattcagaacctgtcatcatcgacaagattgagttcatccccattgaagaatctgttgctgaatttgaagcaaatcaa

SEQ ID NO: 216 - DNA, 2721 bp, Artificial Sequence
  synthetic sequence encoding toxin protein
atggagaaggagctgctgaacctcaagaacaagtacctcaagccggtggcgctggggctgctggccagcaatgtgctggccttcggcggccacaccgtcgcctttgctgaaacaaacaaggccgtcagcaaggagcaaactcagaaggctgatgctctgaagaaggtcaagacgccgctggtgagcttcgccgccacagatggaacatcagagctctccgagctccagaagatcatgaatgaagtcatcaaggaggacaatggcatcaccgacatgttcctccagaggaccaaggagaaggcagagcagaagggcatcgagttcgactacctggagttcatcaagggcgtgctgaatgaaggcatcatgttcactggagaagcaacagaagttcctgtgctgtcattcctcaaccccatcattgatgttttcttccccaagaatgagaaggatgtttgggatcagatcaagcccaaggtggaggagctcatcaatgagaagctggatgaaaggttcacagaagaaaccctcaacaccttggtgctgaagctgaagggcctcaccaagaatgtggagacattgaaggagaacatcaatgtgctaaatggaaaaggagaacatccagacaatgccatgattggagaagctctggttcaaacagacaaggagaaggagcaaggagatgtccgcgcctccgtcaaggatgtggtggccaacatcaatgccatgtctgaagagttcaagaatggaaaatatgctgttgcttctcttcctctctacacccagctggccaacatccacattggcctactgaaggacctcgccgagcatggagaagattggggctacacagagaagcagcaagatcaaaacaaggcagatctccagaaggccatcaagacctacaccaacaccgtctatgaaaccttcaatgaaggcctcaacaagatgaaggagaagcaagggatgtcaaatggctgggatgaggtgaacagatatgtgaggaccatgaccttgacaagcctggattttgcttctcaatggagcatcatggatgtcaccctctaccctcaagcaacccacctggacaagacaaggcagatctacagcgacatctacaaggacaccatcggccacacagattatgacaagaaaactggagatcaatattatgacaagctgctgggcatctactcaaagaaatatcctggagagctgaagaacctcaccatcaacaagtttggccaagatgcatggaccaacaaccacatcaatggcattgatcaagaatatgaaggaagcagctatgactactgggacagccaatgggacaccaagggcatcaaatcaaagcaaggaacaagaggagaaagcctcggcagcgcctccttctccgccgacaagccgctcaccaagaagaacttccctgacatggtgaagaggatcagcaacccagatcagatccctgctggccacaaggtgagccagatcatctcaggcttcagagatggcatctgggacaaccagcccttcatctgcaatgatgtcaccgcctatgttccagaagaaacaagagctgacaccaaggtggatggaagccagattgttgggatcgccgccgacaaggtgagcaccagccagaagtttgagagcgtgctggaatatgtcaatggaggaaatgcaaggaagagctcagagagcggcggcacccttcagtttgaggtgaacagcaccaagaagcagcagttcaaggtgagatacagggtggccagcaacactggaacatcagtggacctctccttgaaggccggcgccgtcaatgacaccggcaagagctatgcaagcaagggcaacacctccatccccaacacagaagctctgaaggacaaccccaagaagggcgtcaccggccttcaaggaacatacatcctggtggaaggccccaccgtcaccctacaacctggagcaaatgctctggagatcaccaacaccggcggcaaggagctggtggtggacaggattgagctggcgccggtgatcagcaaggctggaaatcctggatgggacaaggagcaccagcactactatggaaaatctggagatggcaccaagctggcagaaggagagatggcaacagattggcaatcaattgacaaccagtactactactttggagatgatggaacagtgaaaacaagctggcagctcatcaggaacaagtactactacctcaacaaggatggcaccatgcaaactggatggtactctccttcagagaaggagacatactacctcggcaagaaggatgacaacaccggcctcaaggaaggagagatggccaccggctggatgaacatcaacaactcagagtactacttcggcaagaaggatgacaacaccggcctcaaggaaggccagatggccaccggcaagatcaagattggcaacaaggattatgattttggaaaaaatggagagatgcaaaaggaccagcctggatggaaggatgatcaaaaatattatgttgatgaaaatggcaacagggtcaccggcctaaaaaccatcgacaacttcgagtactactttggaactggagatgatggcaccaacctccaaagaggagagaaggctgttggatggcagaagttcaaggatggccattatgaatatggcgtctgcgtcgccatggagcagaaccatgcaacaagcatctccggccac

SEQ ID NO: 217 - DNA, 2721 bp, Artificial Sequence
  synthetic sequence encoding toxin protein
atggagaaggagctgctgaacctcaagaacaagtacctcaagccggtggcgctggggctgctggcaagcaatgtgctggccttcggcggccacaccgtcgcctttgctgaaacaaacaaggccgtcagcaaggagcaaactcaaaaagctgatgctctgaagaaggtcaagacgccgctggtgagcttcgccgccacagatggaacatcagagctctccgagctccagaagatcatgaatgaagtcatcaaggaggacaatggcatcaccgacatgttcctccagaggaccaaggagaaggcagagcagaagggcatcgagttcgactacctggagttcatcaagggcgtgctgaatgaaggcatcatgttcactggagaagcaacagaagttcctgttctttcattcctcaaccccatcattgatgttttcttccccaagaatgagaaggatgtttgggatcagatcaagcccaaggtggaggagctcatcaatgagaagctggatgaaaggttcacagaagaaaccctcaacaccttggtgctgaagctgaagggcctcaccaagaatgtggaaacattgaaggagaacatcaatgttctaaatggaaaaggagaacatccagacaatgccatgattggagaagctcttgttcaaacagacaaggagaaggagcaaggagatgtccgcgcctccgtcaaggatgtggtggccaacatcaatgccatgtctgaagagttcaagaatggaaaatatgctgttgcttctcttcctctctacacccagctggccaacatccacattggcctactgaaggacctcgccgagcatggagaagattggggctacacagagaagcagcaagatcaaaacaaggcagatctccagaaggccatcaagacctacaccaacaccgtctatgaaaccttcaatgaaggcctcaacaagatgaaggagaagcaaggaatgtcaaatggatgggatgaggtgaacagatatgtgaggacaatgaccttgacaagcctggattttgcttctcaatggagcatcatggatgtcaccctctatcctcaagcaacccacctggacaagacaaggcagatctacagcgacatctacaaggacaccatcggccacacagattatgacaagaaaactggagatcaatattatgacaagctgctgggcatctactcaaaaaaatatcctggagagctgaagaacctcaccatcaacaagtttggacaagatgcatggacaaacaaccacatcaatggcattgatcaagaatatgaaggaagcagctatgactactgggacagccaatgggacaccaagggcatcaaatcaaagcaaggaacaagaggagaaagcctcggcagcgcctccttctccgccgacaagccgctcaccaagaagaacttccctgacatggtgaagaggatcagcaacccagatcagatccctgctggccacaaggtgagccagatcatctcaggcttcagagatggcatctgggacaaccagcccttcatctgcaatgatgtcaccgcctatgttccagaagaaacaagagctgacaccaaggtggatggaagccagattgttgggatcgccgccgacaaggtgagcaccagccagaagtttgagagcgtgctggaatatgtcaatggaggaaatgcaaggaagagctcagaaagcggcggcacccttcaatttgaggtgaacagcaccaagaagcagcagttcaaggtgagatacagggtggcaagcaacactggaacatcagtggacctctccttgaaggccggcgccgtcaatgacaccggcaagagctatgcaagcaagggcaacacctccatccccaacacagaagctctgaaggacaaccccaagaagggcgtcaccggccttcaaggaacatacatcctggtggaaggccccaccgtcaccctacaacctggagcaaatgctctggagatcaccaacaccggcggcaaggagctggtggtggacaggattgagctggcgccggtgatcagcaaggctggaaatcctggatgggacaaggagcaccagcactactatggaaaatctggagatggcaccaagctggcagaaggagagatggcaacagattggcaatcaattgacaaccagtactactactttggagatgatggaacagtgaaaacaagctggcagctcatcaggaacaagtactactacctcaacaaggatggcaccatgcaaactggatggtactctccttcagagaaggaaacatactacctcggcaagaaggatgacaacaccggcctcaaggaaggagagatggccaccggctggatgaacatcaacaattcagagtactacttcggcaagaaggatgacaacaccggcctcaaggaaggccagatggccaccggcaagatcaagattggcaacaaggattatgattttggaaaaaatggagagatgcaaaaagatcaacctggatggaaggatgatcaaaaatattatgttgatgaaaatggcaacagggtcaccggcctaaaaaccatcgacaacttcgagtactactttggaactggagatgatggcaccaacctccaaagaggagaaaaagctgttggatggcagaagttcaaggatggccattatgaatatggcgtctgcgtcgccatggagcagaaccatgcaacaagcatctccggccat

SEQ ID NO: 218 - DNA, 2325 bp, Artificial Sequence
  synthetic sequence encoding toxin protein
atgaggatcaaccccatcatcaagtgcgtcgccaccaccaccctcttctcccagttcctcacctacagcagcgtcagctatgctgaagagaagcagagccaaacaaagatcaagcaggtgatgcaatcagagaaggccagccaggtgagcaatgaaagcagccaagggctgctgggctactacttccaggacagcaacttccagcagctcaccatgatggctcaccgccaagtttcagatctccagatcaccaagaaggaggtgaagaacctgctggctgatgatcagcagcacatcggcagcgtccgctggattggctacatccagccaagccaaactggagactacatcctctccaccagctcagatcagcaggtggtgatcgagctggatggcaagatcatcctcaaccagagctccatgacagaagccatccagctggagaagggcaagccctacaagatcaggattgaatatgttccagagaacaagaagaacaaggacaacctgctggacttcgagctgaactggagcatctcaggaggaacagcagaacctgttcctgacaatgacttcctgctgccagatctctcaaggaagcaagatcaagagaagatcatcccagaaacaagcctcttcgaggagaaaggagaagagaagaatgtttcaagaagcaagaggagcctcgccgtgaacccgctgctggacacagatgatgatggcatctatgatgaatgggaaacaaatggctacaccatccaaggccagctcgccgtcagatggaacaacagcatgaaggagcagaactacccaaaatatgtttcaaatccatacaagagccacactgttgctgatccatacacagattgggagaaggcttctggaaggattgatcaagctgtgaagagagaagcaaagaacccgctggtggcagcatatcctgtggtgggcgtcaacatggagaggctgattgtttcagaaaatcaaaacatctccaccggcctcggccgcaccgtcaccgcctccacctccgcctcctccaccgccggcatcaccgccggcattgatgccaccgtcggcgcctccctgctggggccatcaggatctgtgacagctcacttcagctacactggaagcagcaccgccgccgtggagaacagcagcagcaacaactggagtgatgatcttggcatcaacaccgcccacagcgcctacctcaatgcaaatgtgagatactacaacaccggcacggcgcccatctacaatgtcaccccaacaacaaacttcgtgctggattcagaaaccatcgtcaccgtccgcgccaaggagaaccagcttggtgatgtgctgaaggctggaggaacatatccagagaagcacctcaaccccattgctctcaacaccttggatgattttggatcacagctcatccccatcaactatgatcaaacaaagaggctggagaatggcaacaagctccagctgcaaacaacacaagcaagcggcctctatggcaagatgaacagcaatggaggcctcaacatccatccttctcaagaatgggagccggtgagagctcaaattgagagcgtcagcgccggcatcgtgctggacactggagaagaggtgctagaaagaagggtggcaacaagagatgacagagatccagaagatctgacgccggagatcaccattggagaagccatcaagatcgccttcgacaccaccgagcaaggaggaaaacttcagtacaaggacacgccgctcaatgagagcttggtggagctgattgttgatgaatcaacagcaagggagatcaaggcgcagctggatggaaatcctgggctggagaagaagatctacaatgtcaagctgaagagagggatgaacatcatgctgaagaagcccatctggtacagcgacttcgacacccaccagcacaactggagcaacatcaccattgctcctgaagaaggcatcactggaaatgctggcaagatctcacaaggaagcgtccagccggccttcttgagatatcaaacagtggaggacttcaagaacctcaagccaaacacaagatacaagctctccgcctccatcagatatctggatctggagcccggcggcgtcaccggcgcctacatcagggtgaatgatcttccaaacaatgagtacctcatcagaagcaacctctatgaaaggattgaatcaaccttcaccaccggcatcatcccttctggcatcaccgacttcagaattgccaccaccggcagcagggacatgctgctggatgacatcaccttggtggagctggggccaagcaac

SEQ ID NO: 219 - DNA, 2325 bp, Artificial Sequence
  synthetic sequence encoding toxin protein
atgaggatcaaccccatcatcaagtgcgtcgccaccaccaccctcttctcccagttcctcacctacagcagcgtcagctatgctgaagagaagcaaagccaaacaaagatcaagcaggtgatgcaatcagagaaggcaagccaggtgagcaatgaaagcagccaagggctgctgggctactacttccaagacagcaacttccagcagctcaccatgatggctcaccgccaagtttcagatcttcagatcaccaagaaggaggtgaagaacctgctggctgatgatcagcagcacattggaagcgtcagatggattggctacatccagccttctcaaactggagattacatcctctccaccagctcagatcagcaggtggtgattgagctggatggaaagatcatcctcaaccaaagctccatgacagaagccatccagctggagaagggcaagccctacaagatcaggattgaatatgttccagaaaacaagaagaacaaggacaacctgctggattttgagctgaactggagcatctcaggaggaacagcagaacctgttcctgacaatgatttcttgctgccagatctttcaaggaagcaagatcaagagaagatcatcccagaaacaagcctcttcgaggagaaaggagaagaaaaaaatgtttcaagaagcaaaagaagcctcgccgtgaatcctctgctggacacagatgatgatggcatctatgatgaatgggaaacaaatggctacaccatccaaggccagctcgccgtcagatggaacaacagcatgaaggagcagaactatccaaaatatgtttcaaatccatacaagagccacactgttgctgatccatacacagattgggagaaggcttctggaagaattgatcaagctgtgaagagagaagcaaagaatcctctggtggcagcatatcctgttgttggcgtcaacatggagaggctgattgtttcagaaaatcaaaacatctccaccggcctcggcaggaccgtcaccgcctccacctccgcctcctccaccgccggcatcaccgccggcattgatgccaccgtcggcgcctccttgctggggccatcaggatctgtgacagctcacttcagctacactggaagcagcaccgccgccgtggagaacagcagcagcaacaactggagtgatgatcttggcatcaacactgctcacagcgcctacctcaatgcaaatgtgagatactacaacactggcacggcgcccatctacaatgtcacaccaacaacaaacttcgtgctggattcagaaaccatcgtcaccgtccgcgccaaggagaaccagcttggtgatgtgctgaaggctggaggaacatatccagagaagcacctcaaccccattgctctcaacaccttggatgattttggatcacagctcatccccatcaactatgatcaaacaaaaaggctggaaaatggaaacaagctccagctgcaaacaacacaagcatctggcctctatggaaagatgaacagcaatggaggcctcaacatccatccttctcaagaatgggagcctgttcgagctcaaattgaaagcgtcagcgccggcattgtgctggacactggagaagaagtgctagaaagaagggtggcaacaagagatgacagagatccagaagatctgacgccggagatcaccattggagaagccatcaagatcgccttcgacacaacagaacaaggaggaaaacttcagtacaaggacacgccgctcaatgagagcttggtggagctgattgttgatgaatcaacagcaagagagatcaaggctcagctggatggaaatcctgggctggagaagaagatctacaatgtcaagctgaagagaggaatgaacatcatgctgaagaagcccatctggtacagcgacttcgacacccaccagcacaactggagcaacatcaccattgctcctgaagaaggcatcactggaaatgctggaaagatctcacaaggaagcgtccagccagccttcttgagatatcaaacagtggaggacttcaagaacttgaagccaaacacaagatacaagctctccgcctccatcagatatttggatctggagcctggcggcgtcaccggcgcctacatcagggtgaatgatcttccaaacaatgaatacctcatcagaagcaacctctatgaaaggattgaatcaaccttcaccaccggcatcatcccttctggcatcacagatttcagaattgccaccactggaagcagggacatgctgctggatgacatcaccttggtggagctggggccaagcaac

SEQ ID NO: 220 - DNA, 825 bp, Artificial Sequence
  synthetic sequence encoding toxin protein
atggccatcatcaacctggcaaatgagctggccatctgggccaagagatggtgcgccgagaagggctacacatatgaaagcagcggcctccaagctcacaccggcaactatggaaggatctacaactacaacatctcagttccagatcccatcgtgacagacaaccccaccaacaccgccatggcgcgcggcaccacccccaacagcaccagccagcccatcgtcaggaccatcaccttcaatgaaaccttgacagattctcaaagcaccaccaccgagcatggcatcaccgccggcgtcagcgccaccgtcaaatcagaagctggcttcgtctttgccaaggtgggctttgaggtcaccgtcagcttccagtacaactacaccaccaccaacacctacaccacagaaacatcaagaagctggacagattctctccaggtgacagttcctcctggatatgtcaccgagcacaccttcatcgtccaaacagggccatattcaaaaaatgtggtgctggaagctgacattgctggccatggctggttcaactacagagctcctggctacaccgccaccggcattgtgaacatcaccagggtgctgtatgacaacaaggttcctggcatcacgccatatccagatgatttctatgcaaggttcagaggatcagggaagctggaaggaaagatgggcctccagagcttcgtcaacatcgtggagaggccgctctccggccgcgccggccaggtgagggagtaccagatccccgtcagcctccagagcggcctcggcatccccatctttgatcctgtggtgagcctccag

SEQ ID NO: 221 - DNA, 825 bp, Artificial Sequence
  synthetic sequence encoding toxin protein
atggccatcatcaacttggcaaatgagctggccatctgggcaaaaagatggtgtgctgagaagggctacacatatgaaagctctggccttcaagctcacactggaaactatggaaggatctacaactacaacatctcagttccagatcccattgtgacagacaaccccaccaacaccgccatggcaagaggcaccacgccaaacagcaccagccagcccatcgtcagaaccatcaccttcaatgaaacattgacagattctcaaagcaccacaacagaacatggcatcaccgccggcgtcagcgccaccgtcaaatcagaagctggctttgtttttgcaaaggttggatttgaagtcaccgtcagcttccagtacaactacaccaccaccaacacctacacaacagaaacatcaagaagctggacagattctcttcaagtgacagttcctcctggatatgtcacagagcacaccttcattgttcaaactggaccatattcaaaaaatgtggtgctggaagctgacattgctggacatggatggttcaactacagagctcctggatacaccgccaccggcattgtgaacatcacaagggtgctgtatgacaacaaggttcctggcatcactccatatccagatgatttctatgcaagattcagaggatcaggaaagctggaaggaaagatgggcctccagagcttcgtcaacattgtggagaggcctctctctggccgcgccggccaagtgagggagtaccagattcctgtcagcctccaaagcggccttggcatccccatctttgatcctgttgtcagcttgcag

SEQ ID NO: 222 - DNA, 903 bp, Artificial Sequence
  synthetic sequence encoding toxin protein
atgtacttccgcctcaagttctccaagtacagcaagagcagcaaggcagagaaggaggaggtgaatggcatggccatcatcaacctcctctccgagctggaagcatatggaaggaactatgctgcaagccaccagtacagatatgaaacaagctactctgatgacatggacccgctgaggatctcagccatcaatgaaacagttcctgacaggattgttcaagatggcatcaagaacatcgtgctggacaggaggaacatcaggaacaccaccagctcagagctcaatggagttttctccttcagcaacacctacaccaacaagaacagcacccaaaccattgatggcgtcaccgccggcaccaacatcaccatcaaggccttcgccaacttgatgtttgctgaagttggcctctccggcaacattgcttttgaaggaaacatcaccaactcaaatgtggtgacgctggacaccaaccaagatttcaccgacacaaggaacatctccatccctcctcatcatcaagcaactggcctctacatgctgcaacaaggatcatttgagaagatgaccgtcattgaatgtgttgttgctggaaatggcatcatcagatacacaagatattttcctgatggcagcgccaccgaggtgaggcagcgcgtcagcattgttgatgtgctgcaagcaaatggaactcctggcttcactgtttcaccagggcagcagcaggcctacttcactggagaaggaagggtgtttggccagctggggctgcaaaccttcattgatgtggtgatcgagcctcttcctggctacagcggccagcggcagcagtaccagatccccgtcactggaagaagcggcctggacatccctgtttttgatgctctcggcgtccgccaa

SEQ ID NO: 223 - DNA, 903 bp, Artificial Sequence
  synthetic sequence encoding toxin protein
atgtacttccgcctcaagttctccaagtacagcaagagcagcaaggcagagaaggaggaggtgaatggcatggccatcatcaacctcctctcagagctggaagcatatggaagaaactatgctgcaagccaccagtacagatatgaaacaagctattctgatgacatggacccgctgaggatctcagccatcaatgaaacagttcctgacaggattgttcaagatggcatcaagaacatcgtgctggacagaaggaacatcaggaacaccaccagctcagagctcaatggagttttctccttcagcaacacctacaccaacaagaacagcacccaaacaattgatggcgtcaccgccggcaccaacatcaccatcaaggccttcgccaacttgatgtttgctgaagttggcctctccggcaacattgcttttgaaggaaacatcaccaactcaaatgtggtgacgctggacaccaaccaagatttcaccgacacaaggaacatctccatccctcctcatcatcaagcaactggcctctacatgctgcaacaaggatcatttgagaagatgacagtgattgaatgtgttgttgctggaaatggcatcatcagatacacaagatattttcctgatggaagcgccaccgaggtgaggcagcgcgtcagcattgttgatgttcttcaagcaaatggaactcctggcttcactgtttcaccagggcagcagcaggcctacttcactggagaaggaagggtgtttggccagctggggctgcaaaccttcattgatgtggtgattgagcctcttcctggctacagcggccaaaggcagcagtaccagatccctgtcactggaagaagcggcctggacatccctgtttttgatgctcttggcgtccgccaa

SEQ ID NO: 224 - DNA, 2106 bp, Artificial Sequence
  synthetic sequence encoding toxin protein
atgaaccagaactacaacaacaatggatatgaggtgatggattctggagggatgtaccaccagccaagatatccatatgcaaaagctcctggatcagagttccagcagatgaactacaaggactggatgaaccaatgcaaatggggagaaagtggagagctcttcgccaatgatcttgggccggtgagggacatgctgatcattggaactggcattggatgggcgctgctgggctttgttcctggcatcggccccatcctctcagctgttgctggagtgctgaatgtggccatcccctacctctggccagaagatgctggaactcctggaacaccagaagctcagttctcatgggaccagctgatgacagctgctgagcagatcaccaacaccgccatcaatgctcaagtccgcgccgaggccatcaccgagctgcaaggcatccaagaaaccatcaggctctaccgcggcgccgcctgcgactggaagaatgatccaaacaatgctcagctgaaggagacattaaggacccagttcattgccaccaacaccgtcatcttcaacaggatgccctccttcagagttgctggatttgaaacaagcctgctgccaaccttcgtccaagctgccaacctccacctggggctgctgagagatggagcaaaatttggcctacaatggggcatggacccagcaactgttaacagatattatggctacctcaccagcaacattgccacctacaccaactactgcaccagctggtacaacaccggcctccagcagcagtacaacaccggcaactgggacaagttcaacaacttcagaagggacatgaccatctcagttcttgacatcgtcgccgcctggccaaccttcgacaccaacctctatgctgttccaacaagcagccagctgacaaggacggtgtacacgccgctgcaaggaaacctcggcgccaatgctctctctccagaagcatcaccaagcattgatgtcatcgaggagaacctggtggacacccccggcctcttcaaatggctgcacaaggtgagcttcgaggccatcaatggcctccagagcaccgtcatcaaaggaagaggcattggctacagatacaccatgaatgacagcatcattgatggaggatatcaaggagaacatggcaccatgacagaaactctaccaatcacctaccccaccgacagatacactcctgttggagatgtttggaatgtcaccaaccagctctaccagctgaggctggtgttccctgacaggacagatgtcatctccgccgtccgcggcttcctcttcagaggaacagagccaacagtggtgagcgccatccctgttttctacaaccctggatatccaattgaaacaacatcaggcctcccctgccgcggcatggcctccgtctgtgaaacctgcgagccaaactgcatgccgcagctgccaaatggaggaagcatctgcgagagcggcctccaatatggcaacaggctcagctatgttgggctggggatgctgacagctgttcctggatattatgttggctcgccaacaagatatgctgcatattttggatatggatggacccatgtttcagcaaatgccaacaacctcattgatgctgagaagatcacccagatccccgccgtcaaggcctcctccgtcaccactggagttcaagtcatcaaggggccaggatcaactggaggagatctggtgaagctgggaggaggaaacatcttgatcgccaccttggcgctgaagttcactgttcctgctggacaaaggcagttcagaatcaggatcagatatgcttctaacatgaggaccaacctcaccatctccatgccaggatactcaggaacatattatcctccaacaacaacaacagatctcaccaacctgacatatgacaagttcagctaccaggacatcggcacctacagcttcaacagcagcaatgacagcatcaccagcctcaacctccgcgtccaaggagttggaagcatctcctctgtttcatccttcctgctggacaagatcgagttcatccccatccaaggaagcctggaggagtaccaagctcaagaa

SEQ ID NO: 225 - DNA, 2106 bp, Artificial Sequence
  synthetic sequence encoding toxin protein
atgaaccagaactacaacaacaatggatatgaggtgatggattctggaggaatgtaccaccagccaagatatccatatgcaaaagctcctggatcagagttccagcagatgaactacaaggattggatgaaccaatgcaaatggggagaaagtggagagctcttcgccaatgatcttgggccggtgagggacatgctgatcattggaactggaattggatgggcgctgctgggatttgttcctggcattggccccatcctctcagctgttgctggagttctcaatgttgccatcccctacctctggccagaagatgctggaactcctggaacaccagaagctcagttctcatgggatcagctgatgacagctgctgagcagatcaccaacaccgccatcaatgctcaagttcgcgccgaggccatcacagagctgcaaggcatccaagaaaccatcaggctctaccgcggcgccgcctgcgactggaagaatgatccaaacaatgctcagctgaaggaaacattaagaacacagttcattgccaccaacaccgtcatcttcaacaggatgccatccttcagagttgctggatttgaaacaagcctgctgccaacctttgttcaagctgcaaacctccatcttgggctgctgagagatggagcaaaatttggactacaatggggcatggacccagcaactgttaacagatattatggctacctcaccagcaacattgcaacatacaccaactactgcaccagctggtacaacaccggcctccagcagcagtacaacactggaaactgggacaagttcaacaacttcagaagagacatgaccatctcagttcttgacatcgtcgccgcctggccaacatttgacaccaacctctatgctgttccaacaagcagccagctgacaaggacggtgtacacgccgctgcaaggaaacctcggcgccaatgctctttctccagaagcatcaccaagcattgatgtcatcgaggagaacttggtggacactcctggcctcttcaaatggctgcacaaggtgagctttgaagccatcaatggcctccaaagcaccgtcatcaaaggaagaggaattggctacagatacaccatgaatgacagcatcattgatggaggatatcaaggagaacatggcaccatgacagaaactctaccaatcacctacccaacagacagatacactcctgttggagatgtttggaatgtcaccaaccagctctaccagctgaggctggtgtttcctgacagaacagatgtcatctccgccgtccgcggcttcctcttcagaggaacagaaccaacagtggtgagcgccatccctgttttctacaaccctggatatccaattgaaacaacatcaggcctcccctgccgcggcatggcctctgtttgtgaaacctgcgagccaaactgcatgccgcagctgccaaatggaggaagcatctgcgagagcggcctccaatatggaaacaggctcagctatgttgggctggggatgctgacagctgttcctggatattatgttggatctccaacaagatatgctgcatattttggatatggatggacacatgtttcagcaaatgcaaacaacctcattgatgctgagaagatcacccagatccctgctgtcaaggcctcctccgtcaccactggagttcaagtcatcaaaggaccaggatcaactggaggagatctggtgaagctgggaggaggaaacatcttgatcgccaccttggcgctgaagttcactgttcctgctggacaaaggcagttcagaatcaggatcagatatgcttctaacatgaggacaaacctcaccatctccatgccaggatactcaggaacatattatcctccaacaacaacaacagatctcaccaacttgacatatgacaagttcagctaccaagacattggaacctacagcttcaacagcagcaatgacagcatcaccagcttgaacctccgcgtccaaggagttggaagcatctcttctgtttcatccttcctgctggacaagattgagttcatccccatccaaggaagcctggaggagtaccaagctcaagaa

SEQ ID NO: 226 - DNA, 2043 bp, Artificial Sequence
  synthetic sequence encoding toxin protein
atgaaccagaactgcaagaaggacaagctgaagctctcagattctggcaacagaagctgccagccaagatatcccttcgccaaggaagctggaagcgagctgcaaaacatcaactacaaggactggctggtgatgtgcttggatgagaagcagagcatcagcaacaaccagcagcgcgccgtcatcgacagcgcgctgctgacaacaagcgacatcacccaaaccatcctcaacattggtaacaccgccaccagcctccgctcaccagggatgatcgccggccagatcctgctgctggtgatcaggttcctctggaccaagatctctggtcaaagaaaatggacagagatgatcaagacggtggagctgctgatcaagaaggcgctcatccagcagatgtatgatgaagctgtttcaaggctggaagggctggaggatgtggtggacagatatttgaaggcgctggatgatcttcacatcgaccccaccaacctcaccctacaagaagaggtgaggatcagatttgatgctgctgacaccgccttcattgctgccatgccgcagttccgccctggagttgctggaggagatcctcaggtgctgctgctgccggtgtacacccaagctgccaacctccacctgctgctgctacgtgatgccattgcttttggaggagaatggggcatggaccccgccaccatcaacaccaactacaatgttttcttgacaaggctcagcagctacacagatcattgccgaaacacatatgattctggcctccagaaggctcaccagctgccgccaaactatgactacaagagcaatgattttccatggatctcaccaagcctcaaggatggagtttggggctttgaagaaggctactggaggcatgtcatcgactggaactacttcaacaactacaggagggacatgaccatcatcgtgctggatgtggtgagcctctggccaacatatgatgcaaggatgttccccatccccgtcaagatcgagctgacaagggagctctactcagagctgatgggccagaacaatggagaaaatcaagatcaaattgaaagcatgatcgtccgctcgccgcacctcttcacctggctcaagaccatcaagattggcaccaagcagccaaagagcaactgctcacaaattgatcaatatgctgacatcaaggtcaccctccaccacaccaatgacaacaacctctgggatcaaacaacagtgatcgccgcgccaagaactggagagcaggtgctggagaacagcagctttggaagggtggagctctcaggaacatattctccctacatgttcagattctacaccccctacaatggaggaggatattttgttggccgtgatgttccaaacaccacctgctactcacctcactgcaatggctggggaggctgctcccagagcttgagccagatcagatggtacattggaacagagatcccaagcagcagccttcctcacagccaccgcctcagctacattgatggctgcaccaccaccgagccatattttgacaagagcacctacatctccgcctgggtgttcgcctggacccacaacagcgtcggccccaacaacaccatcttctcagacaagatcacccagatccctgctgtgaaaggaaatggcctggagaacattgccaccggcaccgccaccgtccgccgcggcactggaagcactggaggagattttgttcagctcatcggcaacactcctgctggtgaaggaaggctgcacatcagcttcaccagccttggagcaaggaactacagggtgaggttcagatatggatcaacaactggaggccgcctccgcgtcagcacgccaactggcaacaagtacaccaacatccagaggacatatggaggaggcctccccaccgcctacaatgagttccaatatgctgatcttggagttcaaacagtttatgccaaccactggtttgtgattgttgctgaaactggaacaaatgtcatcatcgacaagatcgagttcatccctgct

SEQ ID NO: 227 - DNA, 2043 bp, Artificial Sequence
  synthetic sequence encoding toxin protein
atgaaccagaactgcaagaaggacaagctgaagctctcagattctggaaacagaagctgccagccaagatatcccttcgccaaggaagctggatcagagctgcaaaacatcaactacaaggattggctggtgatgtgcttggatgagaagcaaagcatcagcaacaaccagcagcgcgccgtcatcgacagcgcgctgctgacaacttctgacatcacccaaaccatcctcaacattggtaacaccgccaccagcctccgctcaccagggatgattgctggccagatcctgctgctggtgatcaggttcctctggacaaagatctctggtcaaagaaaatggacagagatgatcaagacagtggagctgctgatcaagaaggcgctcatccagcagatgtatgatgaagctgtttcaaggctggaagggctggaagatgtggtggacagatatttgaaggcgctggatgatcttcacattgatcccaccaacctcaccctacaagaagaagtgaggatcagatttgatgctgctgacaccgccttcattgctgccatgcctcagttccgccctggagttgctggaggagatcctcaagtgctgctgctgccggtgtacacccaagctgcaaacctccatctgctgctgctacgtgatgccattgcttttggaggagaatggggcatggaccctgccaccatcaacaccaactacaatgttttcttgacaaggctcagcagctacacagatcattgccgaaacacatatgattctggcctccagaaggctcatcagctgccgccaaattatgattacaagagcaatgattttccatggatctcaccaagcctcaaggatggagtttggggatttgaagaaggatactggaggcatgtcatcgactggaactacttcaacaactacagaagagacatgaccatcatcgtgctggatgttgtcagcttgtggccaacatatgatgcaaggatgttccccatccctgtgaagattgagctgacaagggagctctattcagagctgatgggccaaaacaatggagaaaatcaagatcaaattgaaagcatgatcgtccgctctcctcacctcttcacctggctcaagaccatcaagattggaacaaagcagccaaaaagcaactgctcacaaattgatcaatatgctgacatcaaggtcaccctccaccacacaaatgacaacaacctctgggatcaaacaacagtgatcgccgcgccaagaactggagagcaggtgctggagaacagcagctttggaagggtggagctctcaggaacatattctccatacatgttcagattctacacgccatacaatggaggaggatattttgttggccgtgatgttccaaacaccacctgctactcacctcattgcaatggatggggaggctgctcccagagcttgagccagatcagatggtacattggaacagagattccaagcagcagccttcctcacagccaccgcctcagctacattgatggctgcaccaccacagagccatattttgacaagagcacctacatctccgcctgggtgtttgcttggacccacaacagcgtcggccccaacaacaccatcttctcagacaagatcacccagattcctgctgtgaaaggaaatggcctggagaacattgcaactggcaccgccaccgtccgccgcggcactggaagcactggaggagattttgttcagctcattggcaacactcctgctggtgaaggaaggctgcacatcagcttcacctctcttggagcaaggaactacagggtgaggttcagatatggatcaacaactggaggaaggctccgcgtcagcacaccaacaggaaacaagtacaccaacatccaaagaacatatggaggaggcctccccaccgcctacaatgagttccaatatgctgatcttggagttcaaacagtttatgcaaaccattggtttgtgattgttgctgaaactggaacaaatgtcatcatcgacaagattgagttcatccctgct

SEQ ID NO: 228 - DNA, 1845 bp, Artificial Sequence
  synthetic sequence encoding toxin protein
atggacaacaaccccaacatcaatgaatgcatcccctacaactgcttgagcaacccagaggtggaggtgctgggaggagaaaggattgaaactggctacacccccatcgacatctccctctccctcacccagttcctcctctcagaatttgttcctggagctggcttcgtgctgggcctcttcgacctcatctggggcttcgtcggcccttctcaatgggatgccttcctcgtccagatcgagcagctgatcaaccagaggattgaagaatttgcaaggaaccaggccatcagcaggctggaaggcctctccaacctctacaggatctactcagaagccttcagagaatgggaagcagatccaacaaatcctgctctgagggaggagatgaggattcagttcaatgacatgaacagcgcgctggtgacggcgctgccgctcttctccgtccagaactaccaggtgccgctgctctccgtctatgttcaagctgccaacctccacctctccgtgctgagagatgtttcagtttttggccaaagatggggctttgatgtggccaccatcaacagcagatacaatgatctgacaaggaacattggagaatacacagattatgctgtcagatggtacaacaccggcctggagcgcgtctgggggccagattcaagagattgggtgagatacaaccagttcagaagggagctcaccttgacggtgctggacatcatctccctcttccccaactatgattcaaggacatatcccatcaggacggtggcgcagctgacaagggagatctacaccaaccccgtgctggagaactttgatggcagcttcagaggatcagctcaaggaattgaaggaagcatcagatctcctcatctgatggacatcctcaacagcatcaccatctacacagatgctcatcgaggagaatactactggagcggccaccagatcatggcttctcctgttggcctctcaggacctgagttcaccttccctctctatggcaccatgggcaacgccgcgccgcagcagaggatcgtcgcccagctgggccaaggcgtctacaggaccttgagcagcaccctctacaggaggcccttcaacatcggcatcaacaaccagcagctctccgtgctggatggaactgaatttgcatatggaacaagcagcaaccttccttcagctgtctacaggaagagcggcaccgtggacagcttggatgagatcccgccgcagaacaacaatgtgccgccgcgccaaggcttcagccaccgcctcagccatgtgagcatgttcagaagcggcttcagcaacagcagcgtcagcatcatcagggcgccgatgttcagctggattcaccgctctgctgagttcaacaacatcatcccttcttcacagatcacccagatccccctcaccaagagcaccaacctcggcagcggcacctccgtggtgaaggggccaggcttcactggaggtgacatcttgaggaggacatctcctggccagatctccaccctccgcgtcaacatcaccgcgccgctctctcaaagatacagggtgaggatcagatatgcttcaacaacaaacctccagttccacaccagcattgatggccgccccatcaatcaaggaaacttctccgccaccatgagcagcggcaacaacctccagagcggcagcttcagaactgttggcttcaccacccccttcaacttcagcaatggaagctccgtgttcaccctctcagctcatgttttcaacagcggcaatgaggtgtacatcgacaggattgaatttgttcctgctgaagtcacctttgaagcagaatat

SEQ ID NO: 229 - DNA, 1845 bp, Artificial Sequence
  synthetic sequence encoding toxin protein
atggacaacaaccccaacatcaatgaatgcatcccctacaactgcttgagcaatccagaagtggaggtgcttggaggagaaagaattgaaactggatacacccccatcgacatctccttgagcttgacccagttcctcctctcagaatttgttcctggagctggatttgtgctgggcctcttcgacctcatctggggcttcgtcggcccttctcaatgggatgccttcctggttcagattgagcagctgatcaaccaaagaattgaagaatttgcaagaaaccaagccatctcaaggctggaaggcctctccaacctctacaggatctattcagaagccttcagagaatgggaagcagatccaacaaatcctgctttgagagaagagatgaggattcagttcaatgacatgaacagcgcgctggtgacggcgctgcctctcttctccgtccaaaactaccaggtgccgctgctctctgtttatgttcaagctgcaaacctccatctctccgtgctgagagatgtttcagtttttggacaaagatggggatttgatgttgccaccatcaacagcagatacaatgatttgacaagaaacattggagaatacacagattatgctgtcagatggtacaacactgggctggagagggtctggggaccagattcaagagattgggtgagatacaaccagttcagaagagagctcaccttgacagtgctggacatcatctccctcttccccaactatgattcaagaacatatcccatcaggacggtggcgcagctgacaagagagatctacaccaaccctgtgctggagaactttgatggcagcttcagaggatcagctcaaggaattgaaggaagcatcagatctcctcatctgatggacatcctcaacagcatcaccatctacacagatgctcatcgaggagaatactactggagcggccatcagatcatggcttctcctgttggcctctcaggacctgagttcaccttccctctttatggaaccatgggaaatgctgcgccgcagcaaaggatcgtcgcccagctgggacaaggcgtctacagaacattgagcagcaccttgtacagaaggcccttcaacattggcatcaacaaccagcagctctccgtgctggatggaactgaatttgcatatggaacaagcagcaaccttccttcagctgtctacaggaagagcggcaccgtggacagcttggatgagatccctcctcagaacaacaatgtgccgccgcgccaaggcttcagccaccgcctcagccatgtgagcatgttcagaagtggcttcagcaacagcagcgtcagcatcatcagggcgccaatgttcagctggattcacagatctgctgagttcaacaacatcatcccttcttcacagatcacccagattcctctcaccaagagcaccaaccttggaagcggcacctccgtggtgaaaggacctggcttcactggaggtgacatcttgagaagaacttctcctggccagatctccaccctccgcgtcaacatcaccgcgccgctctctcaaagatacagggtgaggatcagatatgcttcaacaacaaatcttcagttccacaccagcattgatggaaggcccatcaatcaaggaaacttctccgccaccatgagctctggcaacaacctccagagcggcagcttcagaactgttggcttcaccacccccttcaacttcagcaatggaagctctgttttcaccttgtcagctcatgttttcaacagtggaaatgaagtttacattgacaggattgaatttgttcctgctgaagtgacatttgaagcagaatat

SEQ ID NO: 230 - DNA, 1908 bp, Artificial Sequence
  synthetic sequence encoding toxin protein
atgaaccagaagaactatgacatcatgggcgcctccaccaatgccaccgccgagctgacagagaactacaacaccatcatctctccatatggagctccaacctccgtcaccaccaccatcgagatcaccggcaccatcctctcagatcttggagttcctggagcaagcagcatctccctgctgctgaacaagctgctctccatcctctggccagatgacaccaacaccatgtggggcaccttcgccaaggaaacagcctacctcctcaatgaggtgctctcaccaaatgatcctgtggtgattgatgctgacaacaagctggaagggctgaagaacaccttggacctctacctggaggcgctgaaggaatggaagaatgatcctcaaaatcctgcttcacaagaaagggtgaggacaaggttcagaaatgttgatgatgatttcacccatgacatgccctcctttgcaagagctggatatgaaacaaagctgctcaccgtctatgctcaagctgccaacctccacctgctgctgctgagagatgcttcaatgtttggagaaggatgggggatgacccaggtgaacatcaatgacaactacaacaggcagctccgcctcaccgcccagtacacagatcattcagtgaaatggtacaatgctgggctggagaagctgaagggcaagctcactggagaaaactggtacacctacaacaggttcagaagggagatgaccttgatggtgctggatgtggtggcgctcttccccaactatgacacaaggatgtaccccattgccaccacctcagagctgacaaggatcatctacacagatccaattgcctacacccaagatcatccatggtacaagatcaccagcttgagcttctctgacatcgagaacagcgccatcccttcaccttccttcttcagatggctgaagagcgtcagcatcaacagccaatggtggggcagcggccccaaccaaacatactactgggtgggccatgagctggtgtacaccaacagcaactacaaccagagcttgaaggtgaaatatggagatccaaacagctacatcgagccgccggacagcttcaacttctcctcaacagatgtctacaggaccatcagcattgccaagaacagcatcagcaactacattgtttctgaggtgaggttcaacagcatcagcaacaccaacaagatctcagaggagatctacaagcatcaaagcaactggccgctgaaggaaacaaaggacagcattgctgagctcagcattgctgcaaatcctccaacaacatttggaaatgttgctgagtacagccaccgcctcgcctacatctcagaagcatacagcagccacaacccaagcaagtaccccgcctacatccctgtttatggatggacccacacctccgtgagatatgacaacaagatctaccctgacaagatcacccagatccccgccgtcaagagcgcctcagtggaaggaggaacatggaagaatgtggtgaaggggccaggcttcactggaggagatgtcaccaccgccgtgtcgccggccaacctcattgatgtcatcaagatccatgtcaccttggacagcaacagcctctctcagaagtacagagcaaggctgagatatgcttcaaatgcatatgttgctgccaccctctacaccaacaccagcagcaactaccattttgagctcaccaaaggaacaacagagcagttctccacctacaacagcttccaatatgtggacatccctggaagcatccagttcaacaacacctcagacaccgtgagcgtctacctccacatggacagcaccaccaatgcttctgttcaagtggacaggatcgagttcatcccggtggacatcaactatgatgaaagagtt

SEQ ID NO: 231 - DNA, 1908 bp, Artificial Sequence
  synthetic sequence encoding toxin protein
atgaaccagaagaactatgacatcatgggcgcctccaccaatgccaccgccgagctgacagaaaactacaacaccatcatctctccatatggagctccaacttctgtcaccaccaccatcgagatcaccggcaccatcctctcagatcttggagttcctggagcaagcagcatcagcttgctgctgaacaagctgctctccatcctctggccagatgacaccaacaccatgtggggcaccttcgccaaggaaacagcctacctcctcaatgaggtgctctcaccaaatgatcctgtggtgattgatgctgacaacaagctggaagggctgaagaacaccttggatctctacctggaggcgctgaaggaatggaagaatgatcctcaaaatcctgcttcacaagaaagggtgaggacaaggttcagaaatgttgatgatgatttcacccatgacatgccatcatttgcaagagctggatatgaaacaaagctgctcaccgtctatgctcaagctgccaacctccatctgctgctgctgagagatgcttcaatgtttggagaaggatgggggatgacccaggtgaacatcaatgacaactacaacaggcagctccgcctcactgctcagtacacagatcattcagtgaaatggtacaatgctgggctggagaagctgaagggcaagctcactggagaaaactggtacacctacaacaggttcagaagagagatgacattgatggtgctggatgtggtggcgctcttccccaactatgacacaaggatgtaccccattgccaccacctcagagctgacaaggatcatctacacagatccaattgcctacacccaagatcatccatggtacaagatcaccagcttgagcttctctgacattgagaacagcgccatcccttcaccttccttcttcagatggctgaagagcgtcagcatcaacagccaatggtggggcagcggccccaaccaaacatactactgggtgggccatgagctggtgtacaccaacagcaactacaaccagagcttgaaggtgaaatatggagatccaaacagctacatcgagccgccggacagcttcaacttctcctcaacagatgtctacaggaccatcagcattgccaagaacagcatcagcaactacattgtttctgaggtgaggttcaacagcatcagcaacaccaacaagatctcagaagagatctacaagcatcaaagcaactggccgctgaaggaaacaaaggacagcattgctgagctcagcattgctgcaaatcctccaacaacatttggaaatgttgctgaatacagccaccgcctcgcctacatctcagaagcatacagcagccacaacccaagcaagtaccccgcctacatccctgtttatggatggacccacacctccgtgagatatgacaacaagatctatccagacaagatcacccagatccctgctgtcaagagcgcctcagtggaaggaggaacatggaagaatgtggtgaaggggccaggcttcactggaggagatgtcaccaccgccgtgtcgccggccaacctcattgatgtcatcaagatccatgtcaccttggacagcaacagcctctctcagaagtacagagcaaggctgagatatgcttcaaatgcatatgttgctgccaccttgtacaccaacaccagcagcaactaccattttgagctgacaaaaggaacaacagagcagttctccacctacaacagcttccaatatgtggacatccctggaagcatccagttcaacaacacctcagacaccgtcagtgtctacctccacatggacagcaccaccaatgcttctgttcaagtggacaggattgagttcatccctgtggacatcaactatgatgaaagagtt

SEQ ID NO: 232 - DNA, 2127 bp, Artificial Sequence
  synthetic sequence encoding toxin protein
atgaacatccagaacagcaatgatgccaacaccaacaggatcttgaacaatggcctctccgtcagcagcaccgccaacctgctggagctggtgcagcaaggaagatcagattatgctggaaaatgctacagcggctacatcgacctcattggagaaccaagaagcacccccatcagcaacaggttctcaaacagcatcctccccaacaccatcaccaatgatccaaggatagtggagacatgtggaaatggaagcatcgtggacaacactgttcaagacagcatcaccaccgtcattgacatcaccaacatcatcctggacctcttcaatgttccaattgttgggccggtgctctcaattgtcaacaggctcatcaacaggctctggccaagcaactatggcaccgccatctgggaggcgctgatggcggaggtggagaagattgtggacaagaagattgatgaagctgtgaagagcaaggcgctctccgagctggaaggcctccagaggatctacagcagctaccaatcagatctggagagatggctgggagacagggacaacccagagtaccaggagatcatcaggcagcagttcaatgtggtgaacaacttcttcgcctaccagatgccctccttcgccgtcagcggctttgagatcctgctgctctccgtctacacccaagctgccaacctccacctcaacctcctccgcgacatcaccgtccatggaactggatggggatattcagaaggaacagtggagagatacaaccagctgcaaagatgcttgatcacagcatatgttgactactgcgtcgaccagtacaacctggagctggagaagctgcccaaggaaaccttgaagaactgggtggactacaacagatacaggagggagatgaccctctcagtgctggacatcgtcagcctcttccccaactatgatgcttctgtttatgatcttcccatcaatgctgagctctcaaggcaggtgtacacagatcctcttggaagctacctcccctacaacaccgccaaccccatcagctggtatgacatgaagagctacatccatccaaacttctggcagatcgacaagtacttcatcaagccgccaaacctcttcaccttcgccgagaagctgatcatgtattcaggctacaggacagatgttgatcccatcttctactactactggagcggcagcaagctggagagcagaagagttcatggaaatgagatcatcaccaccatctctggagacatcagccaaagcatcaccttggtgaatgtggacttcaaggattcagacatctacaagatcaccaccaactacatcggccagtacaccggcagcttgctgggcaccaaccccatcaccttctccctcaccaacagcaatggccaaacagaaagaaaatatgaatattcaaagctgctgatgcctggcaaggagaagatctactacagccaagatgagattcctccaaacattgaaactggagaaccagattatgtggcctacagccaccgcctgagctatgtctccgccttcaaccccaacttcaccagcggcaagaagattggaacagttcccatctatggatggacccacacctctgtttcaagggacaacctcatctaccctgacaagatcacccagatccccatcgtcaagagctatgagattggagaatactacaaggtgatgcaaggacctggcttcaccggcggcgacatcctcaccaagacatatcctgttcaaaatccatcaggaagcacccttgctgcaagaatcagggtgagcaccgccggcatccacctcaaccaaagatacaccttgaggatgcattatgctgcttctggatctgtttatgatgccatgatcatcaagcctggacaatcagaaggaggctaccacatgaggctcaaccccaccatggagaatggagaaaccctcaccttcaacagcttcaccagcattgggatgaacagccaggtgctcaccagcagccaaactgatctcaccctctacatcaagagcatgtcgccgtcgacgccgggcaccatctacatcgacaggatcgagttcatcccggtggacaacaactatgaagcagagcag

SEQ ID NO: 233 - DNA, 2127 bp, Artificial Sequence
  synthetic sequence encoding toxin protein
atgaacatccagaacagcaatgatgccaacaccaacaggatcttgaacaatggcctctccgtcagcagcaccgccaacctgctggagctggtgcagcaaggaagatcagattatgctggaaaatgctacagcggctacatcgacctcattggagaaccaagaagcacccccatcagcaacaggttctcaaacagcatcctccccaacaccatcaccaatgatccaaggatagtggaaacatgtggaaatggaagcatcgtggacaacactgttcaagattccatcaccaccgtcattgacatcaccaacatcatcctggatctcttcaatgttccaattgttgggccggtgctctcaattgtcaacaggctcatcaacaggctctggccaagcaactatggcaccgccatctgggaggcgctgatggcagaggtggagaagattgtggacaagaagattgatgaagctgtgaagagcaaggcgctctcagagctggaaggcctccagaggatctacagcagctaccaatcagatctggaaagatggctgggagatcgagacaatccagagtaccaggagatcatcaggcagcagttcaatgtggtgaacaacttcttcgcctaccagatgccatccttcgccgtcagcggctttgagatcctgctgctctccgtctacacccaagctgccaacctccacctcaacctcctccgcgacatcaccgtccatggaactggatggggatattcagaaggaacagtggaaagatacaaccagctgcaaagatgcttgatcacagcatatgttgactactgcgtggatcagtacaacctggagctggagaagctgccaaaagaaacattgaagaactgggtggactacaacagatacagaagagagatgaccctctcagtgctggacatcgtcagcctcttccccaactatgatgcttctgtttatgatcttcccatcaatgctgagctctcaaggcaggtgtacacagatcctcttggaagctacctcccctacaacaccgccaaccccatcagctggtatgacatgaagagctacatccatccaaacttctggcagatcgacaagtacttcatcaagcctccaaacctcttcaccttcgccgagaagctgatcatgtattcaggctacagaacagatgttgatcccatcttctactactactggagcggcagcaagctggagagcagaagagttcatggaaatgagatcatcaccaccatctctggagacatcagccaaagcatcaccttggtgaatgtggacttcaaggattcagacatctacaagatcaccaccaactacattggccagtacaccggcagcttgctgggcaccaaccccatcaccttctccctcaccaacagcaatggacaaacagaaagaaaatatgaatattcaaagctgctgatgcctggcaaggagaagatctactacagccaagatgaaattcctccaaacattgaaactggagaaccagattatgttgcctacagccaccgcctgagctatgtttctgccttcaaccccaacttcaccagcggcaagaagattggaacagttcccatctatggatggacccacacctctgtttcaagggacaacctcatctatccagacaagatcacccagatccccatcgtcaagagctatgaaattggagaatactacaaggtgatgcaaggacctggcttcaccggcggcgacatcctcaccaagacatatcctgttcaaaatccatcaggaagcacccttgctgcaagaatcagggtgagcaccgccggcatccacctcaaccaaagatacaccttgaggatgcattatgctgcttctggatctgtttatgatgccatgatcatcaagcctggacaatcagaaggaggctaccacatgaggctcaaccccaccatggagaatggagaaaccctcaccttcaacagcttcaccagcattgggatgaacagccaggtgctgacaagcagccaaactgatctcaccctctacatcaagagcatgtcgccgtcgacgccgggcaccatctacatcgacaggattgagttcatccctgtggacaacaactatgaagcagagcag

SEQ ID NO: 234 - DNA, 1896 bp, Artificial Sequence
  synthetic sequence encoding toxin protein
atgaacagcaagagcatcatcgagaaaggagttcaagaaaaccagtacatcgacatcaggaacatctgctccatcaatggcagcgccaagttcaaccccaacaccaacatcaccaccttaactgaagccatcaacagccaagctggcgccattgctggaaaaacagctctggacatgagaagagatttcaccttggtggccgacatctaccttggaagcaagagcagcggcgctgatggcattgccattgccttccaccgcggctcaattggcttcatcggcaccatgggaggaggcctcggcatccttggagctccaaatggcattggcttcgagatcgacacctactggaaggcttcttctgatgaaactggagacagcttcggccatggccagatgaatggacctcatgctggatttgtttcaacaaacagaaatgccaactacctcaccgcgctggcgccgatgcaaaagatccctgctccaaatgacagatggaggatcttgaccatcaactgggatgcaaggaacaacaagctgacagcaaggctgcaagagaagagcaatgatgatccaacaagatcagcaacaccaaactaccaaacatgggagctgctgaaccccgccttcgacctcaaccagaagtacaccttcgtcatcggcagcgccaccggcgccgccaacaacaagcaccagattggcatctcattgtttgaagcatacttcaccaagcccaccattgttgctcatcctgtggacatcgagattggaacagcatttgatcctctgaactacgagcccatcggcctcaaggcaacagatgaggtggatggagacatcaccaaggacatcaccgtggagttcaatgatgtggacacctcaaagcccggcgcctacagggtcacctacaaggtggtgaacagctatggagaaagtgatgaaacagccattgccatcgtcgtctacaccaagcccaccatcactgctcatgatgtggccatcaagaaggaactagcatttgatcctctcaactacgagcccatcggcctcaaggcaacagatccaattgatggagacatcactgatgagatctccgtcaagttcaacaatgtggacaccagcaagcctggaaaatatcatgtcacctacaaggtggtgaactcatatgagaagagcgacgagaaaacagtggagatcaccgtctacaccaagcccatcattgaagcatatgatgtggagatcaagaaggacaccgcctttgatcctctcaactacgagcccatcggcctcaaggccatcgaccccattgatggagacatcaccgacaaggtgacggtggaatcaaatgatgtggacaccagcaagcccggcgcctacagggtgaagtacaaggtggtgaacaactatgaagaaagtgatgaaaaaaccattgctgtcactgttcctgtcattgatgatggctgggagaatggagatccaacaggatggaagttcttctctggagaaaccatcaccttggaagaagatgaagaaaatgctctaaatggaaaatgggtgttctatgctgacaagcatgtggccatctacaagcaggtggagctgaagaacaacaccccctaccagatcaccgtctatgtcaagccagaagatgaaggaactgttgctcaccacatcgtcaaggtttcattcaagagcgacagcgccggccaagaaagcgaggagatcatcaatgaaaggctgattgatgctgagcagatccagaagggctacaggaagctggcctccatccccttcacccccaccaccattgttccaaacaagaagcctgtcatcatcgtggagaacttccttcctggatggattggaggagtgaagatcatcgtggagccaacaaaa

SEQ ID NO: 235 - DNA, 1896 bp, Artificial Sequence
  synthetic sequence encoding toxin protein
atgaacagcaagagcatcatcgagaaaggagttcaagaaaaccagtacatcgacatcaggaacatctgctccatcaatggcagcgccaagttcaaccccaacaccaacatcaccaccttaactgaagccatcaacagccaagctggcgccattgctggaaaaacagctctggacatgagaagagatttcaccttggtggccgacatctaccttggaagcaagagcagcggcgctgatggcattgccattgccttccaccgcggctcaattggcttcatcggcaccatgggaggaggcctcggcatccttggagctccaaatggcattggatttgagatcgacacctactggaaggcttcttctgatgaaactggagacagcttcggccatggccagatgaatggacctcatgctggatttgtttcaacaaacagaaatgccaactacctcaccgcgctggcgccgatgcaaaagatccctgctccaaatgacagatggaggatcttgaccatcaactgggatgcaaggaacaacaagctgacagcaaggctgcaagagaagagcaatgatgatccaacaagatcagcaacaccaaactaccaaacatgggagctgctgaaccccgccttcgacctcaaccagaagtacaccttcgtcatcggcagcgccaccggcgccgccaacaacaagcaccagattggcatctcattgtttgaagcatacttcaccaagcccaccattgttgctcatcctgtggacatcgagattggaacagcatttgatcctctgaactatgagcccatcggcctcaaggcaacagatgaggtggatggagacatcaccaaggacatcaccgtggagttcaatgatgtggacacctcaaagcccggcgcctacagggtcacctacaaggtggtgaacagctatggagaaagtgatgaaacagccattgccatcgtcgtctacaccaagcccaccatcactgctcatgatgtggccatcaagaaggaactagcatttgatcctctcaactatgagcccatcggcctcaaggcaacagatccaattgatggagacatcactgatgagatctccgtcaagttcaacaatgtggacaccagcaagcctggaaaatatcatgtcacctacaaggtggtgaactcatatgagaagagcgacgagaaaacagtggagatcaccgtctacaccaagcccatcattgaagcatatgatgtggagatcaagaaggacaccgcctttgatcctctcaactatgagcccatcggcctcaaggccatcgaccccattgatggagacatcaccgacaaggtgacggtggaatcaaatgatgtggacaccagcaagcccggcgcctacagggtgaagtacaaggtggtgaacaactatgaagaaagtgatgaaaaaacaattgctgtcactgttcctgtcattgatgatggatgggagaatggagatccaacaggatggaagttcttctctggagaaaccatcaccttggaagaagatgaagaaaatgctctaaatggaaaatgggtgttctatgctgacaagcatgtggccatctacaagcaggtggagctgaagaacaacaccccctaccagatcaccgtctatgtcaagccagaagatgaaggaactgttgctcatcacatcgtcaaggtttcattcaagagcgacagcgccggccaagaaagcgaggagatcatcaatgaaaggctgattgatgctgagcagatccagaagggctacaggaagctggcctccatccccttcacccccaccaccattgttccaaacaagaagcctgtcatcatcgtggagaacttccttcctggatggattggaggagtgaagatcatcgtggagccaacaaaa

SEQ ID NO: 236 - DNA, 954 bp, Artificial Sequence
  synthetic sequence encoding toxin protein
atgaagttcaacaagctgatggtgagcggcattgccttcgtctgctcctccaccttcttcaccgcctacatccaagctgctgagatcgaggagaacaagaacagcaccacggcgctctcagaaagcagggaggagctcttcggcatagtggatgtggacaagagcttcgacaagatggcgcagtactactacttcaagaacctccaaggaaagattgaaaatggctacaagttcaccaactacaaaggaagctcaacaaacctggacaagttcaagaccaccagcgacaaggtgagcgacctccagatcaccggcctgctgccggagtacatcggcggcaacaccttccccaaccacacagagcaggagcagaccttctcaacaacaagctatgcaaggaccatcactgagagcgtcaccaccaccacccagagcggcttctctgtttctggccaaggagggctgctgaacatccccatcatcttcccaaatggaacaagcatcaccgcctccatcaacaccagctcaaccttggccaagcaagaaagtgacacaaggaccttgacagctccttctcaagctgtcaaggttcctcctggaaaaacctaccgcgccgaggtgaagctggtgaggaagagcttcaaggctaatgttggcttcaatggcaccattgctcctcctctctcaacagacatcaagatgaatgcaagatgggaaggagctggaggaaggccaaacaagaccgtcaccaagagctatgccacccaaaccctctacagggacatgacgccaagccagcagaaggatcttggcatcaccttcaacagcaccaccggccagtttgatgtcaatggcaaggccgtcattgatggcattgctggatcagagatggaggtggccatctatgacatcaccaatgcaaggacgcccaagctggtgagcaagacctactac

SEQ ID NO: 237 - DNA, 954 bp, Artificial Sequence
  synthetic sequence encoding toxin protein
atgaagttcaacaagctgatggtttctggcattgccttcgtctgctcctccaccttcttcaccgcctacatccaagctgctgagattgaggagaacaagaacagcaccacggcgctctcagaaagcagagaagagctctttggaatagtggatgtggacaagagcttcgacaagatggcgcagtactactacttcaagaacctccaaggaaaaattgaaaatggctacaagttcaccaactacaaaggaagctcaacaaatctggacaagttcaagacaacaagcgacaaggtgagcgacctccagatcactgggctgctgccagagtacattggaggcaacaccttccccaaccacacagagcaggagcaaaccttctcaacaacaagctatgcaagaaccatcactgaaagcgtcaccaccaccacccagagcggcttctctgtttctggacaaggagggctgctgaacatccccatcatcttcccaaatggaacaagcatcaccgcctccatcaacaccagctcaacattggccaagcaagaaagtgacacaaggaccttgacagctccttctcaagctgtcaaggttcctcctggaaaaacataccgcgccgaggtgaagctggtgaggaagagcttcaaggctaatgttggcttcaatggcaccattgctcctcctctctcaacagacatcaagatgaatgcaagatgggaaggagctggaggaaggccaaacaaaactgtcaccaagagctatgcaacacaaaccctctacagggacatgacaccaagccagcagaaggatcttggcatcaccttcaacagcaccaccggccaatttgatgtcaatggcaaggctgtcattgatggcattgctggatcagagatggaggtggccatctatgacatcaccaatgcaaggacgccaaagctggtgagcaagacatactac

SEQ ID NO: 238 - DNA, 2019 bp, Artificial Sequence
  synthetic sequence encoding toxin protein
atggccttcaagaatgatgaaacaccaaacagcaccgacagcaacacagaggacatctccaccctcaagacagcagaaacttctgtttctgggccggccaagctctacagcagctgctcattgacagagaagagcttgtatgagattgaaaatgaatggaagagatggagcaaaggaaatgacttcctctacatcccgccggtggtgggcaccgtcagcagcttgatcctccagaagattgctgggatgattggagacaagctgctgaaatcagtttttgagaagctcttcccaacaccaaatcctgtcaccatgctggagatcctggaagctgttcagaagctgctggatgaaaggctgagccaagaagttcatcaaaggatcaccttggagctggaaggactacagcagaacatcaccaacttcctggaggatgtggaggattttgaaggcctcatcatcatcgacaagctggaggatggcaaccagccgctggccatcatcgacagcatcaacaccttgaaccagctatttgacaacaggatgccgcagttcagaaatccaagctacaaggtgctgctgctgccgctctatgctcaagctgccaacctccacatcagcttcttgaaggatgtggtggacaatgcaagcaaatggggcctcaccgccagccagatcaagacctacaccaacaggttcctggacaagatctcagagtacagcaactactgcattgaaacatatcaacatgacttccagagcaagttcagccagaagctgcaagatgtgctgaagtacaggaacttcatgaccatcaatgtgctggactacaccagcctctggccaatgctgaggttcaccaagcccttcaacatcaggacatcaagcaacctctatgagatggggccgacgcctggagaagatttcatcttcccatattcaagctgggccaacttcaacaggatcttccaaggcttccccaacaaggagctgcaaagcatctccgccaccaacaggttctaccgcgcctacaagcagagcggcggctggagcatgctggccatcactgaggtgatgggcaacctcacctgcaactactcaggaggaaaaagcatcaagtttggatatgagagcttgccaagctgccctgatgacactggagttcaaagatgtgatgctgtcaaggaggagatcaatgatttctcaagaagccagctcaaccaggtgctgctctcctcctccatctccaccaccaaccctccctacatgagcgccaagtacctccaaaatgtcaagctctcaaatggcaccgtctacaacctcatcaatggtgaatatggaagctggatcagctaccccaactacaccatcaggaacatcatcggctgggccaagttcatggagagcaaggccaccaacatcattgaaggaccaagcaaccaatatgaaggcagcttgagaggaaacctctcaacaagcatcgtcagcttccaaagaagagaatatgatccatacaccatctacaatggcgtcaagaggcacaccatccccagccacacaagaggagtgctgatctcgccgctggaatattcagacaccttcaatgttggaactggcaccaagggcaagttcgtcatccatgaaaggcatggcaacaatggagatgctgtcatcatccccaagacaaatggaggctaccgccatggcttcgagtacatcctcttcaacccatatggcaccaacctcaacatcgacatctatgtgaaggtttcagttcctgttcaaacaaagctggtgtacctcatcaatggagctggcctcaccaaggagatcgtcacctcaacagacaatgatggagtgacagacaatggccagaagagcaagatcatcaagctctacagcaacaagcagctggtgccaggaaacaccaccttctccatcagaaatggaggcctcggcgacatctacctggaaggcatcgtggtggtgccaaatggaagcagcttgatctcaaggatc

SEQ ID NO: 239 - DNA, 2019 bp, Artificial Sequence
  synthetic sequence encoding toxin protein
atggccttcaagaatgatgaaacaccaaacagcaccgacagcaacacagaggacatctccaccctcaagacagcagaaacttctgtttctgggccggccaagctctacagcagctgctcattgacagagaagagcttgtatgaaattgaaaatgaatggaagagatggagcaaaggaaatgatttcctctacatcccgccggtggtgggcaccgtcagcagcttgatcctccagaagattgctgggatgattggagacaagctgctgaaatcagtttttgagaagctcttcccaacaccaaatcctgtcaccatgctggagatcctggaagctgttcagaagctgctggatgaaaggctgagccaagaagttcatcaaaggatcaccttggagctggaaggactacagcagaacatcaccaacttcctggaagatgtggaagattttgaaggcctcatcatcatcgacaagctggaagatggcaaccagccgctggccatcatcgacagcatcaacaccttgaaccagctatttgacaacaggatgccgcagttcagaaatccaagctacaaggtgctgctgctgccgctctatgctcaagctgccaacctccacatcagcttcttgaaggatgtggtggacaatgcttcaaaatggggcctcaccgccagccagatcaagacctacaccaacaggttcctggacaagatctcagagtacagcaactactgcattgaaacatatcaacatgatttccagagcaagttcagccagaagctgcaagatgtgctgaagtacaggaacttcatgaccatcaatgtgctggactacaccagcctctggccaatgctgaggttcaccaagcccttcaacatcaggacatcaagcaacctctatgagatggggccgacgcctggagaagatttcatcttcccatattcaagctgggccaacttcaacaggatcttccaaggcttccccaacaaggagctgcaaagcatctccgccaccaacaggttctaccgcgcctacaagcagagcggcggctggagcatgctggccatcactgaggtgatgggcaacctcacctgcaactactcaggaggaaaaagcatcaagtttggatatgagagcttgccaagctgccctgatgacactggagttcaaagatgtgatgctgtcaaggaggagatcaatgatttctcaagaagccagctcaaccaggtgctgctctcctcctccatctccaccaccaaccctccctacatgagcgccaagtacctccaaaatgtcaagctctcaaatggcaccgtctacaacctcatcaatggtgaatatggaagctggatcagctaccccaactacaccatcaggaacatcattggatgggccaagttcatggagagcaaggccaccaacatcattgaaggaccaagcaaccaatatgaaggcagcttgagaggaaacctctcaacaagcatcgtcagcttccaaagaagagaatatgatccatacaccatctacaatggcgtcaagaggcacaccatcccaagccacacaagaggagtgctgatctcgccgctggaatattcagacaccttcaatgttggaactggcaccaagggcaagttcgtcatccatgaaaggcatggcaacaatggagatgctgtcatcatccccaagacaaatggaggctaccgccatggcttcgagtacatcctcttcaacccatatggcaccaacctcaacatcgacatctatgtgaaggtttcagttcctgttcaaacaaagctggtgtacctcatcaatggagctggcctcaccaaggagatcgtcacctcaacagacaatgatggagtgacagacaatggccagaagagcaagatcatcaagctctacagcaacaagcagctggtgccaggaaacaccaccttctccatcagaaatggaggcctcggcgacatctacctggaaggcatcgtggtggtgccaaatggaagcagcttgatctcaaggatc

SEQ ID NO: 240 - DNA, 1929 bp, Artificial Sequence
  synthetic sequence encoding toxin protein
atgtcgccaaacaaccaaaatgaatatgagatcatcgacacgccatcaaggacctccgtcagcaatgagagcttcagatatcctctggccagcaaccagagcaccagcctccagaacaggaactacaaggactggctgaacaccttggaaggaggaaacaaccaaggcttcatcaacattgaaggaaggctctcactggagcaggtgctggctgtctccgccggcgtcgccagctacatcctctccaacctcggccccttcggcgtgttcttcagctacatcatcggcgccttctggccgacggcgccatcagacacaagagtttgggaggccttcatggagctgattgaagcaaggatcgaccagaagatccaagaaagcacaaggaaggatgccattgcaaggctgcaaggccttggagctgcttcagaagtttatcaagaaagcctggagagctggctggagaaccaaaatgatgctcgcgccatgagcgtcgtccgccagcagttcgtcgccttcgagctggacttcgtcaccgccatgcccttcttcgagaggagcggcgacgagatcctgctgctggccgtctatgctcaagctgccaacctccacctgctgctgctgagagatgcttcattgtatggagcagattggggcatggagccatatgacattgccaactactacaacaggcagaaggagaggacagctacctacagcaaccactgcatggaatggtacaagaaggggctggatgagctctggagcgccggcggctatggaggagatgtttggcaggactacaatgatttcagaagggagatgaccctctcagtgctggattttgttgctctcttccccaactatgacacccacctctaccccatcgaggtgaaaggagagctgacaagggagatctacacgccgggcatcaacatcgacatcgacagaggaaggctgggcaaggtcacccttgaaaatgctctggtgaactcgccgcgcctcttctcatggctgaaggagatccagctcttcaccaacatcaacttcaacccaagatggaagttcctctctgcaacaaggattggctacaagctcaccggctacaggagcgtcaacttcgagccatatgaaggcttctactttgaaggcctcttccaatcaaacttcaccctcaatgactaccaggagatctacattgttgatgtgacaagatttggaagcctctatgacacgccgacggccatcaccgccatgaccttcttcaaggatgacaacaccaccttcaactacagcagcaacacgccatcaggagaaccaatgatcaccagcggcttctaccttcctggcattgatggcagcgaggagccaacaagcaacaacttcagccaccgcctctccaccatcaacacctacaacaccaccaaccaaaccttctaccacacctttggatggacccatgtttcagttgacaggaacaacaccatcgtcagcaacaagatcacccagatccccttcgtcaaggccaacactggaaatgtggtgagaggacctggccacactggaggagatctggtggtgttcaagccggcggcgcggccggacatcgtcctccgcgtcggcaacacaaggctgcaaagctacagggtgcgcgtcagatatgcttcaaatgctgacatcagcttggagctggacacaacatatgaaaaaacaaacatccacctccagaaaaccttcaacagctcagaagcagaagatctgacatatgacaacttccaatatgctgaagctgacaacatcgtctggctgggccaagatctctctcagtacatcgagttccaaaatgccatcaccaatgacagcaccgccattgcatattttgaaagggtggagttccttcctgttggagcaacatatgaagcagagcag

SEQ ID NO: 241 - DNA, 1929 bp, Artificial Sequence
  synthetic sequence encoding toxin protein
atgtctccaaacaaccaaaatgaatatgagatcatcgacacaccatcaagaacctccgtcagcaatgagagcttcagatatcctcttgcaagcaaccaaagcaccagcctccagaacaggaactacaaggattggctgaacaccttggaaggaggaaacaaccaaggcttcatcaacattgaaggaaggctctcattggagcaggtgctggctgtctccgccggcgtggcaagctacatcctctccaaccttggccccttcggcgtgttcttcagctacatcatcggcgccttctggccgacggcgccatcagatacaagagtttgggaggccttcatggagctgattgaagcaaggattgatcagaagatccaagaaagcacaaggaaggatgccattgcaaggctgcaaggccttggagctgcttcagaagtttatcaagaaagcctggagagctggctggagaaccaaaatgatgcaagggccatgagcgtcgtccgccagcagttcgtcgccttcgagctggattttgtcaccgccatgcccttctttgaaaggagcggcgacgagatcctgctgctggctgtttatgctcaagctgcaaacctccatctgctgctgctgagagatgcttcattgtatggagcagattggggcatggagccatatgacattgcaaactactacaacaggcagaaggaaagaacagctacatacagcaaccactgcatggaatggtacaagaaggggctggatgagctctggagcgccggaggatatggaggagatgtttggcaagattacaatgatttcagaagagagatgaccctctcagtgctggattttgttgctctcttccccaactatgacacccacctctaccccatcgaggtgaaaggagagctgacaagggagatctacactcctggcatcaacatcgacattgatcgaggaaggctgggcaaggtcacccttgaaaatgctctggtgaactcgccgcgcctcttctcatggctgaaggagatccagctcttcaccaacatcaacttcaacccaagatggaagttcctctctgcaacaaggattggctacaagctcactggctacagaagcgtcaacttcgagccatatgaaggcttctactttgaaggcctcttccaatcaaacttcaccttgaatgactaccaagagatctacattgttgatgtgacaagatttggaagcctctatgacacgccgacggccatcaccgccatgaccttcttcaaggatgacaacaccaccttcaactacagcagcaacacaccatcaggagaaccaatgatcacctctggcttctaccttcctggaattgatggatcagaggagccaacaagcaacaacttcagccaccgcctctccaccatcaacacctacaacaccaccaaccaaaccttctaccacacctttggatggacacatgtttcagttgacaggaacaacaccatcgtcagcaacaagatcacccagatccccttcgtcaaggccaacactggaaatgtggtgagaggacctggccacactggaggagatctggtggtgttcaagccggcggcgcggccagacatcgtcctccgcgtcggcaacacaaggctgcaaagctacagggtgcgcgtcagatatgcttcaaatgctgacatcagcttggagctggacacaacatatgaaaaaacaaacatccatctgcaaaaaaccttcaacagctcagaagcagaagatctgacatatgacaacttccaatatgctgaagctgacaacattgtttggctgggccaagatctttctcaatacattgagttccaaaatgccatcaccaatgacagcaccgccattgcatattttgaaagggtggagttccttcctgttggagcaacatatgaagcagaacaa

SEQ ID NO: 242 - DNA, 1593 bp, Artificial Sequence
  synthetic sequence encoding toxin protein
atggagctgattgaagcaaggatcgaccagaagatccaagaaagcacaaggaaggatgccattgcaaggctgcaaggccttggagctgcttcagaagtttatcaagaaagcctggagagctggctggagaaccaaaatgatgctcgcgccatgagcgtcgtccgccagcagttcgtcgccttcgagctggacttcgtcaccgccatgcccttcttcgagaggagcggcgacgagatcctgctgctggccgtctatgctcaagctgccaacctccacctgctgctgctgagagatgcttcattgtatggagcagattggggcatggagccatatgacattgccaactactacaacaggcagaaggagaggacagctacctacagcaaccactgcatggaatggtacaagaaggggctggatgagctctggagcgccggcggctatggaggagatgtttggcaggactacaatgatttcagaagggagatgaccctctcagtgctggattttgttgctctcttccccaactatgacacccacctctaccccatcgaggtgaaaggagagctgacaagggagatctacacgccgggcatcaacatcgacatcgacagaggaaggctgggcaaggtcacccttgaaaatgctctggtgaactcgccgcgcctcttctcatggctgaaggagatccagctcttcaccaacatcaacttcaacccaagatggaagttcctctctgcaacaaggattggctacaagctcaccggctacaggagcgtcaacttcgagccatatgaaggcttctactttgaaggcctcttccaatcaaacttcaccctcaatgactaccaggagatctacattgttgatgtgacaagatttggaagcctctatgacacgccgacggccatcaccgccatgaccttcttcaaggatgacaacaccaccttcaactacagcagcaacacgccatcaggagaaccaatgatcaccagcggcttctaccttcctggcattgatggcagcgaggagccaacaagcaacaacttcagccaccgcctctccaccatcaacacctacaacaccaccaaccaaaccttctaccacacctttggatggacccatgtttcagttgacaggaacaacaccatcgtcagcaacaagatcacccagatccccttcgtcaaggccaacactggaaatgtggtgagaggacctggccacactggaggagatctggtggtgttcaagccggcggcgcggccggacatcgtcctccgcgtcggcaacacaaggctgcaaagctacagggtgcgcgtcagatatgcttcaaatgctgacatcagcttggagctggacacaacatatgaaaaaacaaacatccacctccagaaaaccttcaacagctcagaagcagaagatctgacatatgacaacttccaatatgctgaagctgacaacatcgtctggctgggccaagatctctctcagtacatcgagttccaaaatgccatcaccaatgacagcaccgccattgcatattttgaaagggtggagttccttcctgttggagcaacatatgaagcagagcag

SEQ ID NO: 243 - DNA, 1593 bp, Artificial Sequence
  synthetic sequence encoding toxin protein
atggagctgattgaagcaaggattgatcagaagatccaagaaagcacaaggaaggatgccattgcaaggctgcaaggccttggagctgcttcagaagtttatcaagaaagcctggagagctggctggagaaccaaaatgatgcaagggccatgagcgtcgtccgccagcagttcgtcgccttcgagctggattttgtcaccgccatgcccttctttgaaaggagcggcgacgagatcctgctgctggctgtttatgctcaagctgcaaacctccatctgctgctgctgagagatgcttcattgtatggagcagattggggcatggagccatatgacattgcaaactactacaacaggcagaaggaaagaacagctacatacagcaaccactgcatggaatggtacaagaaggggctggatgagctctggagcgccggcggctatggaggagatgtttggcaagactacaatgatttcagaagagagatgaccctctcagtgctggattttgttgctctcttccccaactatgacacccacctctaccccatcgaggtgaaaggagagctgacaagggagatctacactcctggcatcaacatcgacatcgacagaggaaggctgggcaaggtcacccttgaaaatgctctggtgaactcgccgcgcctcttctcatggctgaaggagatccagctcttcaccaacatcaacttcaacccaagatggaagttcctctctgcaacaaggattggctacaagctcactggctacagaagcgtcaacttcgagccatatgaaggcttctactttgaaggcctcttccaatcaaacttcaccttgaatgactaccaggagatctacattgttgatgtgacaagatttggaagcctctatgacacgccgacggccatcaccgccatgaccttcttcaaggatgacaacaccaccttcaactacagcagcaacacaccatcaggagaaccaatgatcacctctggcttctaccttcctggaattgatggatcagaggagccaacaagcaacaacttcagccaccgcctctccaccatcaacacctacaacaccaccaaccaaaccttctaccacacctttggatggacacatgtttcagttgacaggaacaacaccatcgtcagcaacaagatcacccagatccccttcgtcaaggccaacactggaaatgtggtgagaggacctggccacactggaggagatctggtggtgttcaagccggcggcgcggccagacatcgtcctccgcgtcggcaacacaaggctgcaaagctacagggtgcgcgtcagatatgcttcaaatgctgacatcagcttggagctggacacaacatatgaaaaaacaaacatccatctgcaaaaaaccttcaacagctcagaagcagaagatctgacatatgacaacttccaatatgctgaagctgacaacattgtttggctgggccaagatctttctcagtacattgagttccaaaatgccatcaccaatgacagcaccgccattgcatattttgaaagggtggagttccttcctgttggagcaacatatgaagcagagcaa

SEQ ID NO: 244 - DNA, 1155 bp, Artificial Sequence
  synthetic sequence encoding toxin protein
atgttcaacatcaagtacagcaccagccaaaggaagctcaacctcatcaaggcgctcttcaagaatggcatcctctccgtctacaccaacatctatgtttgtgaaaggttcaacctcaacttctcagtgaaggaaggaattggctacatgaagaacaacaagaggctgaggaagaagatcctcgccttcggcgccattgcttccatcggcaccaccttggtcaccgcctcgccgctggtgatctcagcaaaaacagagtacaacaatgagcagcagctcatcacccagatcaaccagaaggagaacagcttcccaaatgttgctcttggaacacaatggctcttcagctactatgacaagtacctccgcgccaatggcctcatcagagctgctcccttcgtcaccgtcaaggatctggaggtgaagaacagctatggccagctggccatggagccgcaggtgatgtcaacaacgccgctctgggctggacaaagtgatctggagaacaccaccgacagggagcaaaccctcaacagcatggagttcagaaaaacctacagcaacaccaccagcagctcaacagagcatggcttcatgctgggaacagaaaccaccgtcaagacaggcatccccttcctggcagaaggaaacatcaccttgaaggcagagtacaacttcaatgacacccaaggatatgaaacatcagaaacagtggaatatgttgctccaagccagcaggtgattgttcctcctcaaaccattgcaaggatcaccgccaccttggatgtcaagaagatcaagggcaagatggacctctactcagagatcggcctcaacaaggaagaatatggatatgacaagatcccaacatatcatgtttttgaagggatgaaggaccccatcacccttggaagcatctatgatgatgcctacaagcaagctcagaaggatggcttctcagagattccagagatcaagagcttgagcaggagcttcaacaacccagattacttcctcgcctccggcgtcggcagctttgaatcagaatatggctccgtgttcaatgtcaaggtggagtacatcaacatcaagaccaagaagattgaaaaaacagagaacatcgtggtgcagccaaagatcaacagcttgaaggag

SEQ ID NO: 245 - DNA, 1155 bp, Artificial Sequence; identical to SEQ ID NO: 244
  synthetic sequence encoding toxin protein

SEQ ID NO: 246 - DNA, 999 bp, Artificial Sequence
  synthetic sequence encoding toxin protein
atgtaccagatgaagaacaacaagaagatcaggaagaagttcctggcgctctccgccattgcttccatcggcgtcaccttcgccaccatctcgccggagctcacctctgctgctcagctggacaccatccagaaaacatcaagcatcaatgaatttgctggagaaacaaaaaccatccaagattggcagacgccgctgacagaagcagagctggtgtttggcaagcacctggattctcaaagggagtacaggacatcaattggagatgccaagtaccacatgaaggacatcaagttccacagcaatgctgtttctccagatgggccgccaaacttcactgatgttggagatgtttttgttggccatgccaccctcaacaatgatctggatgagaagattgatctgaaaacagacagcttctcaaggacgctcaccgacagcgtcaccacctccaccactcatggcttcaagattggagaaaaaacttctggcaagatctccttccccattggagagatgagccaggagctctccttggagtacaacttctccaccaccgacagccaaacaaacactgattcaaggacctacaccatcccttctcaaaccatccccgtcaagcctcacagctccgtggaggtcatcgtcatgctgaagaggagcaaggccactggaaatgtcaacctcctcaccaagatgagcggcagggtggacaactggaaccactgctactaccctcttcctggtgaacaatatggcaagaactatgttcactcaggaagcattgcttccatggtgaaatatgccaagaacttcgagaagctgccaaacctctccgtcaacctggatgacaccatcaacctcattggaaaaggaacatatgaagcagaatttggaacagaatattctgtcaccgtccgccccatcgacaagaagggcaagtacaccggcgccgactacacctacaccgtcaagccagaggtgacaaaagcagaagct

SEQ ID NO: 247 - DNA, 999 bp, Artificial Sequence
  synthetic sequence encoding toxin protein
atgtaccagatgaagaacaacaagaagatcaggaagaagttcctggcgctctccgccattgcttccatcggcgtcaccttcgccaccatctcgccggagctcacctctgctgctcagctggacaccatccaaaaaacatcaagcatcaatgaatttgctggagaaacaaaaaccatccaagattggcagacgccgctgacagaagcagagctggtgtttggcaagcacctggattctcaaagggagtacaggacatcaattggagatgccaagtaccacatgaaggacatcaagttccacagcaatgctgtttctccagatgggccgccaaacttcactgatgttggagatgtttttgttggccatgccaccctcaacaatgatctggatgagaagattgatctgaaaacagacagcttctcaaggacgctcaccgacagcgtcaccacctccaccactcatggcttcaagattggagaaaaaacttctggcaagatctccttccccattggagagatgagccaggagctctccttggagtacaacttctccaccaccgacagccaaacaaacactgattcaaggacctacaccatcccttctcaaaccatccctgtgaagcctcacagctccgtggaggtcatcgtcatgctgaagaggagcaaggccactggaaatgtcaacctcctcaccaagatgagcggcagggtggacaactggaaccactgctactatcctcttcctggtgaacaatatggcaagaactatgttcactcaggaagcattgcttccatggtgaaatatgccaagaacttcgagaagctgccaaacctctccgtcaacctggatgacaccatcaacctcattggaaaaggaacatatgaagcagaatttggaacagaatattctgtcaccgtccgccccatcgacaagaagggcaagtacaccggcgccgactacacctacaccgtcaagccagaggtgacaaaagcagaagct

SEQ ID NO: 248 - DNA, 912 bp, Artificial Sequence
  synthetic sequence encoding toxin protein
atgaccctcaccatgagcatcatcgacatcaagaaggatgtcatcgaccatgcaaaatggaatgcttccacctactacaatgcaaatccagacaccttctgtgaagaaaccatctatgatttctccgtctttgatctgaaggtggagcccaccgtcaccgccattgatgtccgccccaccctccgcgtcagcatcagcaagaccatcgagaacccaacatcacaaagccagttcagagaggtgagcttcacagaaaatgtcaagaacacctacaccacctacaccaaggaaggcttcctcctccagaaccccatcacagagatccacagcttccccatcaccctcacctttgacatgtacaccgtcaagcagaagatcaatgtcaatgttcctggagaatatcactacagcagcttggaccccatcaccatgacgcgtgaaaggctatgggagctcacctccgccatctccatccctccaaaaacaagggtcaccgccaccttgatggtgtacaagggcaccttcaatgttcccatcaggctgcatgccaccatcagaggagcatatgcctacaatggaagatattatgcaaattcagttcaatatgctgattggttccagaagcagcacatagctttccacaccgcctcctccctcttcatcgacaaggatcaatgggctggctacaagaccatgtatgtttcagcaagcaaggatgatgacagcctccacatcaatggcagcggcatcaacaaggtcacctgctgcctctatgccatcatccacttcgaggagaagagcatgttctacaaccagatggtgaagaaggaatatgattctcccatctacttcgccaacaccatgctgcaaccagggatgctgggaaatgagatccccatcatcaaccccatc

SEQ ID NO: 249 - DNA, 912 bp, Artificial Sequence; identical to SEQ ID NO: 248
  synthetic sequence encoding toxin protein

SEQ ID NO: 250 - DNA, 1884 bp, Artificial Sequence
  synthetic sequence encoding toxin protein
atggagaactctccaaggaactaccccatcagctacaccaccagcagcacccaagaagaaaacttccagttcatcagcaagctggacaggaagatcgagctgctgaacaagctgaagctgggcctcaccaccggccagtacctggacatcatcctggagatcttcaaggacatcaaggcaaggaagattgactacctctccttcatcaacatctcactgccgctgatcaccatcggcgtccccaaggtgggcatcaccgtgcccttcctctccctcttcttccccaagacctccggcatcttctccaccgtggagatccctgatgttttcaccatcatcaagcaggacattcagaacatcttcaagctcatcctcactgatgagcagatcaacaacctcaacaccatggtgctgaagctggaggtttcaatgaagaactacatcgacatcctcaatggcatcaagagcaaccccaccaacttcttcgccatctacaacaacaccgacaccatcatcacagagatcattgatgagttcatcaagttcaactacacagagctgcacatcacctacttctcagtttttgccaccatccacctgatgatgcacagagatgtcatcatccatggagaaaaatggggcttcacagaagatttcatcaaccagaagaaggccgacatcaagaagatgatccagcgctacatctcaattggagacatcctctttgaaagaggcctcaacaagctgctgaacaatgagcaaacccacaatggcatcgacagctgcatccagaagctggcgctctatggccccaacatctacaggctctggccaacattagatccagacacatatcctgtctacacccagatcgagcagaagagggtgctcttcaacagcgacatcaccagggacaccaagaaccaggacaagatcaacattgctgaggacaatgaaggcatcttcaaccagtacaagcattcaacaaccttggacaacattgatgtctgcaaggagaacttgatctacaacacctccatcgacttcaacagaaatggcctcaacaacaaatgcttcagccacaacatcatcggcgacattgattctggcaaggacaccttcctctccaagatcaagggcgtggtggtggccaactacagcaacaaccaaggagatctggtgacagaatggatcaatggaggatcaacagtgaagctgggccaaacccagatcgtcgccatccccatcaccgtgctggacaaccatgtctaccagatcaggctgagatatgcaactgagaaccatgttggagcaaacatgtggatgtgcatccagaacaaccaaactggagacacgccgctcaacaccaagctctccttcgccgcgcccattgattcaaacagcatcaaaggaaaatatggcaagtacatcctcaacatcattgaaaatgattgtgaaaacaaggacatcaccttgaatgctggaagctacaccatcttcatcaagaacatcatggagaagaacctcttcctggacaggatcgagttctacaagaacaccatcaagaacaacaccctcatcatccttccagcaagggagctggtttctccatcaggaggaggacctggatggaccaacctctgggtggcagaaacaaaccagattggcaaggcctttgaagcagagaacagcgtgagcaaaggagaatacaagttctacttcaatggcaccttggtgggctcaacacaaggaaacaccttctatgagaacttcgacaccgtccagatctacttctacaactgcgtggtggacatcttcaacagcttcaccggcgccaacatctggattgagaagccaagccaggagtacttcaagagcaacctc

SEQ ID NO: 251 - DNA, 1884 bp, Artificial Sequence; identical to SEQ ID NO: 250
  synthetic sequence encoding toxin protein

SEQ ID NO: 252 - DNA, 2019 bp, Artificial Sequence
  synthetic sequence encoding toxin protein
atgaacaacaatgaatatgagatcatcgacctccatgcttctctctacagcagcaacaggaacatcaacaacagcagatatccatacaccaacaaccccaacagaagcctccagaacaccaactacaaggactggatgaacatgtgccagcagaaccagcaatatggagaaaattctcaaacatttgcttcagcagaaaccattgctgctgtttctgctggtagcatcgtggtgggcaccatcctcggcgccatggccttcccgccgctcggcgccgccgccatcatcagcttcggcaccatcctccccatcatctgggcgcctggtcaagatgcaaggacagtttggaagagcttcttgaccatcggcaacaggccatttggccttcctgttgatgaagccattgtttcattgctgtatggaagagttcaagctctccgcgtggaggtggaggactaccaaagatattttgacatctggtatgccaaccccatccctcaaaatgcctcgccgctgaagagcaagttcctcaccttggacaccctcatcatcggcgcgctggaggagctcaccaaggactacagcatcaccctgctgccaggatatgctcaggtggcatcatggcacctgatgctgctgaagcatgctgctgtctactatgacagatgggcagcaagcagcaacctctccatccagagcatctaccctcaagactacaccagcaacctccaaacctgcctcaccaactgcgccaaggaatcagagaacaaggtgagcagcaagtactacaaatgcatcctcaagtgccgcatcaatgagtacatcaactactgctccaccaagtaccaagaaggcctcaacaggctgaagaacagctcaggcatcaactggaacatctacaacacctacaggagggagatgaccctcaccgtgctggatctgatcgccaccttccccaactttgatccagagaagtacaccattgccaccaacagccagctgacaagggagatctacacagaagctcttctacaagaacctggcatcccgcgccccatcaatgaaagagaaagccagctgacaaggccagaaggcctcttcacccacctggatcttcttcagttccacacccagatcaactcagattttgttcccatcagaggcctccgcggcgtccagaacttcatgagcttcatcggcggcaacaccttcaatggccccatccaccagccggcgacgccgccatcaagctacattgagatcatcagggagcagccgctcaatgtttctggagaaagcaaccagatctacaagatctccgtcacccaagctccaagcagctacaggacaacaagcattgatttcaacttgatcaatggaagcacaaggcagtacaggagcggcagcagccatgttggatcagagatcaccatcttcgagttccccaagttccccaaggacaagattcctccaaacagatcagagtacagccatgtggtgagctatgtcaaggtggggcctgaagaaactcctggcgtcatcttctacacccagctctccttcgcctggacccacacctccgtggacttcaacaacatcatctacaacaagagcatcacccagatccccgccgtcaaggcatatgagctctcaacagacagcaaggtggtgaaggggcctggccacactggaggtgatctggtggagctgaaggactacatgttcttcaagctgctggtgcctcaaggatctgttggaagctacaaggtgaggatcagatatgcttcaaatgctccaaaccagaacatcggcctcaccagaggcttctaccaagatcaaagccttcctcaaaccttcaaccacagcaactacaatgatctgaaatattcagattttcaatatgccaccttccctcttcctgtcacctacaccggcgcgctcaccgacaccatctccctccatggcctgaggaacaaccccaacaggatcttcatcgacaagatcgagttcatccccaac

SEQ ID NO: 253 - DNA, 2019 bp, Artificial Sequence
  synthetic sequence encoding toxin protein
atgaacaacaatgaatatgagatcatcgacctccatgcttctctctacagcagcaacaggaacatcaacaacagcagatatccatacaccaacaaccccaacagaagcctccagaacaccaactacaaggactggatgaacatgtgccagcagaaccagcaatatggagaaaattctcaaacatttgcttcagcagaaacaattgctgctgtttctgctggtagcattgtggtgggcaccatcctcggcgccatggccttcccgccgctcggcgccgccgccatcatcagctttggcaccatcctccccatcatctgggctcctggtcaagatgcaagaacagtttggaagagcttcttgaccatcggcaacaggccatttggccttcctgttgatgaagcaattgtttcattgctgtatggaagagttcaagctctccgcgtggaggtggaggactaccaaagatattttgacatctggtatgcaaaccccatccctcaaaatgcttcgccgctgaagagcaagttcctcaccttggacaccttgatcatcggcgcgctggaggagctcaccaaggactacagcatcaccttgctgccaggatatgctcaagttgcatcatggcatctgatgctgctgaagcatgctgctgtctactatgacagatgggcagcaagcagcaacctctccatccaaagcatctatcctcaagattacaccagcaacctccaaacatgcctcaccaactgcgccaaggaatcagaaaacaaggtgagcagcaagtactacaaatgcatcctcaaatgccgcatcaatgaatacatcaactactgctccaccaagtaccaagaaggcctcaacaggctgaagaacagctcaggcatcaactggaacatctacaacacctacagaagagagatgaccctcaccgtgctggatctgatcgccaccttccccaactttgatccagagaagtacaccattgccaccaacagccagctgacaagggagatctacacagaagctcttctacaagaacctggcatcccaaggcccatcaatgaaagagaaagccagctgacaaggccagaaggcctcttcacccatctggatcttcttcagttccacacccagatcaattcagattttgttcccatcagaggcctccgcggcgtccagaacttcatgagcttcatcggcggcaacaccttcaatggccccatccaccagccggcgacgccgccatcaagctacattgagatcatcagggagcagcctctcaatgtttctggagaaagcaaccagatctacaagatctccgtcacccaagctccaagcagctacagaacaacaagcattgatttcaacttgatcaatggaagcacaaggcagtacagaagcggcagcagccatgttggatcagagatcaccatcttcgagttccccaagttccccaaggacaagattcctccaaacagatcagaatacagccatgtggtgagctatgtcaaggtggggcctgaagaaactcctggtgtcatcttctacacccagctctccttcgcctggacccacacctccgtggacttcaacaacatcatctacaacaagagcatcacccagatccctgctgtcaaggcatatgagctctcaacagacagcaaggtggtgaaaggacctggccacactggaggtgatctggtggagctgaaggactacatgttcttcaagctgctggttcctcaaggatctgttggaagctacaaggtgaggatcagatatgcttcaaatgctccaaatcaaaacattggcctcacaagaggcttctaccaagatcaaagccttcctcaaaccttcaaccacagcaactacaatgatctgaaatattcagattttcaatatgccaccttccctcttcctgtcacctacaccggcgcgctcaccgacaccatctccctccatggcttgaggaacaaccccaacaggatcttcatcgacaagattgagttcatcccaaat

SEQ ID NO: 254 - DNA, 2088 bp, Artificial Sequence
  synthetic sequence encoding toxin protein
atggtgatgagctccgtcagcattggaggaaagaagatgagccagaacaaccaaaatgaatatgacatcattgatgtcagcagcggcaacttcatcagcaatgattctgtcagatatcctctggccaacaaccccaaccacaccctccagaacatcaactacaaggactacctgaacatgtctgaaggaaattcagtggagctcttcggcgacagccaagccttcaacagggtggcaacagctcaaactggcctcgccatcgtcggcggcgcgctgggagctcttggagttccatttgctggagaaattgctggcctcttctccttcatcctggacctcttctggccatcacaagaaactgatgtttgggagatgatcatggatcaagttcaaggcctcatcgaccagagcatcaccgccaatgtcagatcacaagccattgccaagctggaaggcctcggccgcggcctggaggcctaccaggagctgctggtggcatggctggagaacaggaacaatgcaaggacaaggagcttgatcaagcagcaatatgttgctcttgagcagatcttcaccaccggccttccagagttctcagttcagaaccaggaggtgccgctgctgggcgtctatgctcaagctgccaacctccacctgctgctgctgagagatgtcagcatctttggagcagaatggggctttgaagattatgagattgatgttttctacaacaggcagatgagatacaccgccgagtacgccaactactgcgtggaatggtacaacaaggggctggacaggctaaaaggaacagacaggatcagctggatgaagtaccaccagttcagaagggagatgacgctgctggtgctggacatcgtcgccctcttccccaactatgatgcaagaagatatcctctggagacagaagctcagctgacaagggaggtgtacacagatcccatcgtctacaacccagaagaatttcttggaggcttctgcaacagctggacatcagacaaccagagcgacttctcccagattgaaaatgctgtcatcaggcctcctcatgtttttgacaccattgcttctctggagatcaacacagcaagaggaaggattgctctgaacaacaccgcctacatcgacttctgggctggccacagcctcaccttcagatatccaaatgattctgctcgccatcaagttcaatatggcaccatcacctcagagaagaacagcttccccttcgaggtcactgatgtggtgcaagtcaacaccaccgccgccaacctggcaaatgcctaccagcaagcatatggagcgccgcgcgccgtgttccagctggtgaacaggctcaatggagctgttggaagcctcacctactcaaaaacccacaccgccatccaggcctgcacccagagcttgaacaccaactctgagatcccaaggctgccagtttcacctggcgtcaccaacctctccaccctctacacccacaggatcagccacataacaagctacaacttcagcaacaacctcgccggcaacaggaacagatatggcaacttccctgtttttgtttggacccaccgctctgctgagatcgacaacaagatctatgccaacaagatcacccagatccccgccgtcaaggcgctctgggcttcttcagagccttatcctgtggtgagaggacctggcttcaccggcggcgacattgcaaggctgccaaacaaccccaacatcggcctccgcttcctgctggacccagaacctggagttctcttcaacaggaggttcagagtgaggatcagatttgcttgtgacagcggcgcgcgcgtcatcctcactgatgaaactggcatcaactcagaaaccatcgtgctgaatcaaacaatgacaacagaaaatccaaggaaatatgatgacttccagtacatcgagagcagaaatgtctacaccttgacaagatttcctgggccatggatctggaggctgggagctcaatctgctgatcaaacaagaaatgtctacatcgacaggatcgagttcatccccctcaacccggcgctggaagcagaaaat

SEQ ID NO: 255 - DNA, 2088 bp, Artificial Sequence
  synthetic sequence encoding toxin protein
atggtgatgagctccgtcagcattggaggaaagaagatgagccaaaacaaccaaaatgaatatgacatcattgatgtcagcagcggcaacttcatcagcaatgattctgtcagatatcctctggccaacaaccccaaccacaccctccagaacatcaactacaaggactacttgaacatgtctgaaggaaattcagtggagctctttggagacagccaagccttcaacagggtggcaacagctcaaactggcctcgccatcgtcggcggcgcgctgggagctcttggagttccatttgctggagaaattgctggcctcttctccttcatcctggatctcttctggccatcacaagaaactgatgtttgggagatgatcatggatcaagttcaaggcctcatcgaccaaagcatcaccgccaatgtcagatcacaagcaattgccaagctggaaggcctcggccgcggcctggaggcctaccaggagctgctggtggcatggctggagaacaggaacaatgcaagaacaaggagcttgatcaagcagcaatatgttgctcttgagcagatcttcaccaccggccttccagagttctcagttcaaaaccaggaggtgccgctgctgggcgtctatgctcaagctgcaaacctccatctgctgctgctgagagatgtcagcatctttggagcagaatggggatttgaagattatgaaattgatgttttctacaacaggcagatgagatacacagcagagtatgcaaactactgcgtggaatggtacaacaaggggctggacaggctaaaaggaacagacaggatcagctggatgaagtaccaccagttcagaagagagatgacgctgctggtgctggacatcgtcgccctcttccccaactatgatgcaagaagatatcctctggaaacagaagctcagctgacaagggaggtgtacacagatcccatcgtctacaatccagaagaatttcttggaggcttctgcaacagctggacatcagacaaccagagcgacttctcccaaattgaaaatgctgtcatcaggcctcctcatgtttttgacaccattgcttctctggagatcaacacagcaagaggaaggattgctctgaacaacaccgcctacatcgacttctgggctggccacagcttgaccttcagatatccaaatgattctgctcgccatcaagttcaatatggcaccatcacctcagagaagaacagcttccccttcgaggtcactgatgttgttcaagtcaacaccaccgccgccaacctggcaaatgcctaccagcaagcatatggagctccgcgcgccgtgttccagctggtgaacaggctcaatggagctgttggaagcctcacctactcaaaaacacacaccgccatccaagcctgcacccagagcttgaacaccaactctgagattccaaggcttcctgtttcacctggtgtcaccaacctctccaccttgtacacccacaggatcagccacataacaagctacaacttcagcaacaacctcgccggcaacaggaacagatatggaaacttccctgtttttgtttggacccaccgctctgctgagatcgacaacaagatctatgcaaacaagatcacccagatccctgctgtcaaggcgctctgggcttcttcagaaccttatcctgtggtgagaggacctggcttcaccggcggcgacattgcaaggctgccaaacaaccccaacattggcctccgcttcctgctggacccagaacctggagttctcttcaacagaagattcagagtgaggatcagatttgcttgtgacagcggcgcgcgcgtcatcctcactgatgaaactggcatcaattcagaaaccatcgtgctgaatcaaacaatgacaacagaaaatccaagaaaatatgatgatttccagtacattgaaagcagaaatgtctacaccttgacaagatttcctggaccatggatctggaggcttggagctcaatctgctgatcaaacaagaaatgtctacatcgacaggattgagttcatccctctcaacccggcgctggaagcagaaaat

SEQ ID NO: 256 - DNA, 2052 bp, Artificial Sequence
  synthetic sequence encoding toxin protein
atgagccagaacaaccaaaatgaatatgacatcattgatgtttcttctggaaacttcatcagcaatgattctgtcagatatcctctggccaacaaccccaaccacaccctccagaacatcaactacaaggactacctgaacatgtcagaaggaaattctgttgagctctttggagattctcaagccttcaacagggtggcaacagctcaaactggcctcgccatcgtcggcggcgcgctgggagctctaggagttccatttgctggagaaattgctggcctcttctccttcatcctggacctcttctggccaagccaagaaactgatgtttgggagatgatcatggatcaagttcaaggcctcatcgaccagagcatcaccgccaatgtcagatcacaagccattgccaagctggaaggccttggaagagggctggaggcctaccaggagctgctggtggcatggctggagaacaggaacaatgcaaggacaaggagcttgatcaagcagcaatatgttgctcttgagcagatcttcaccaccggccttccagagttctcagttcagaaccaggaggtgccgctgctgggcgtctatgctcaagctgccaacctccacctgctgctgctgagagatgtcagcatctttggagcagaatggggctttgaagattatgagattgatgttttctacaacaggcagatgagatacacagcagaatatgccaactactgcgtggaatggtacaacaaggggctggacaggctaaaaggaacagacaggatcagctggatgaagtaccaccagttcagaagggagatgacgctgctggtgctggacattgttgctctcttccccaactatgatgcaagaagatatcctctggagacagaagctcagctgacaagggaggtgtacacagatcccatcgtctacaacccagaggagttcctcggcggcttctgcaacagctggacatcagacaaccagagcgacttctcccagattgaaaatgctgtcatcaggcctcctcatgtttttgacaccattgcttctctggagatcaacacagcaagaggaaggattgctctgaacaacaccgcctacatcgacttctgggctggccacagcctcaccttcagatatccaaatgattctgctcgccatcaagttcaatatggcaccatcacctcagagaagaacagcttccccttcgaggtcactgatgtggtgcaagtcaacaccaccgccgccaacctggcaaatgcctaccagcaagcatatggagcgccgcgcgccgtgttccagctggtgaacaggctcaatggagctgttggaagcctcacctactcaaaaacccacaccgccatccaggcctgcacccagagcttgaacaccaactctgagatcccaaggctgccagtttctcctggcgtcaccaacctctcaaccctctacacccacaggatcagccacataacaagctacaacttcagcaacaacctcgccggcaacaggaacagatatggcaacttccctgtttttgtttggacccaccgctctgctgagatcgacaacaagatctatgccaacaagatcacccagatccccgccgtcaaggcgctctgggcttcttcagagccttatcctgtggtgagaggacctggcttcactggaggagacattgcaaggctgccaaacaaccccaacatcggcctccgcttcctgctggaccctgagcccggcgtcctcttcaacaggaggttcagagtgaggatcaggttcgcctgcgacagcggcgcgcgcgtcatcctcactgatgaaactggcatcaactcagaaaccatcgtgctgaatcaaacaatgacaacagaaaatccaaggaaatatgatgacttccagtacatcgagagcagaaatgtctacaccttgacaagatttcctgggccatggatctggaggctgggagctcaatctgctgatcaaacaagaaatgtctacatcgacaggatcgagttcatccccctcaacccggcgctggaagcagaaaat

SEQ ID NO: 257 - DNA, 2052 bp, Artificial Sequence
  synthetic sequence encoding toxin protein
atgagccaaaacaaccaaaatgaatatgacatcattgatgtttcttctggaaacttcatcagcaatgattctgtcagatatcctctggccaacaaccccaaccacaccctccagaacatcaactacaaggactacttgaacatgtcagaaggaaattctgttgagctctttggagattctcaagccttcaacagggtggcaacagctcaaactggcctcgccatcgtcggcggcgcgctgggagctctaggagttccatttgctggagaaattgctggcctcttctccttcatcctggatctcttctggccaagccaagaaactgatgtttgggagatgatcatggatcaagttcaaggcctcatcgaccaaagcatcaccgccaatgtcagatcacaagcaattgccaagctggaaggccttggaagagggctggaggcctaccaggagctgctggtggcatggctggagaacaggaacaatgcaagaacaaggagcttgatcaagcagcaatatgttgctcttgagcagatcttcaccaccggccttccagagttctcagttcaaaaccaggaggtgccgctgctgggcgtctatgctcaagctgccaacctccatctgctgctgctgagagatgtcagcatctttggagcagaatggggctttgaagattatgaaattgatgttttctacaacaggcagatgagatacacagcagaatatgcaaactactgcgtggaatggtacaacaaggggctggacaggctaaaaggaacagacaggatcagctggatgaagtaccaccagttcagaagagagatgacgctgctggtgctggacattgttgctctcttccccaactatgatgcaagaagatatcctctggaaacagaagctcagctgacaagggaggtgtacacagatcccatcgtctacaatccagaagagttcctcggcggcttctgcaacagctggacatcagacaaccagagcgacttctcccagattgaaaatgctgtcatcaggcctcctcatgtttttgacaccattgcttctctggagatcaacacagcaagaggaaggattgctctgaacaacaccgcctacatcgacttctgggctggccacagcctcaccttcagatatccaaatgattctgctcgccatcaagttcaatatggcaccatcacctcagagaagaacagcttccccttcgaggtcactgatgttgttcaagtcaacaccaccgccgccaacctggcaaatgcctaccagcaagcatatggagcgccgcgcgccgtgttccagctggtgaacaggctcaatggagctgttggaagcctcacctactcaaaaacacacaccgccatccaagcctgcacccagagcttgaacaccaactctgagatcccaaggcttcctgtttctcctggcgtcaccaacctctcaaccctctacacccacaggatcagccacataacaagctacaacttcagcaacaacctcgccggcaacaggaacagatatggaaacttccctgtttttgtttggacccaccgctctgctgagatcgacaacaagatctatgccaacaagatcacccagatccctgctgtcaaggcgctctgggcttcttcagaaccttatcctgtggtgagaggacctggcttcactggaggagacattgcaaggctgccaaacaaccccaacattggcctccgcttcctgctggaccctgaacctggcgtcctcttcaacagaagattcagagtgaggatcagatttgcctgcgacagcggcgcgcgcgtcatcctcactgatgaaactggcatcaattcagaaaccatcgtgctgaatcaaacaatgacaacagaaaatccaagaaaatatgatgatttccagtacattgaaagcagaaatgtctacaccttgacaagatttcctggaccatggatctggaggctgggagctcaatctgctgatcaaacaagaaatgtctacatcgacaggattgagttcatccctctcaacccggcgctggaagcagaaaat

SEQ ID NO: 258 - DNA, 1995 bp, Artificial Sequence
  synthetic sequence encoding toxin protein
atgtcgccaaacaaccaaaatgaatatgagatcattgatgcaacaccaagcacctccgtcagcaatgacagcaccaaatatccatatgcaaatgagccaacaaatgctctccagaacatgaactacaaggactacttgaggatgtcagaaggatatgacaacaagtacttcgccaacccagaagtttttgctgctcctggaggcatcaccaccggcatcaccatcgtcaccaagctgctgggctggctggggctgccatttgctggagaaactggcatggcgctcaacttcatcctcggcctcctctggccaacatcaggaaatccatgggcggagctgatgatcctggtggaggagctcatcaaccaaaagattgaagaagctgtgaggaacaaggcgctggcagatctggccaactcaggccgcgcgctgcaaagctacctcaatgcttttgaagattggcagaagaaccccaacatcttcagaagcaaggagctggtgagagaaagatttgcaaatgctgagcacagcttgaggacagagatgagcagcttcgccatcagaggatttgagatcccgctgctggcaacatatgctcaagctgcaaatctacatctcttcctcatcaaggatgttcagatctatggcaaggaatggggctacacccaagctgacatcgacctcttctacagggagcaggtggagttcaccaaggagtacacagagcactgcatcaacatctacaatgatggcctcaaccagctgaagggctcaaatgccaagcaatggatcgccttcaacaggttcagaagggagatgaccctcaccgtgctggatgtggtggcgctcttcagcaactatgatgtgaggatgtaccccatcaagacaacaacagagctgacaaggaccatctacacagatcctcttggctacaccaagacaggaagctcaagcacgccgccatggtacaactatggaagcagcttcagctacatcgagagcgtcgccatccctgctccttccttggtgaaatggctctcacaaattgagatctacagcaagagcgccaaggcgacgccgcagagcgccgactactgggctggccacaccatcacctaccattatggaggagacaatggccaagctgttgcaaactatggagacaggaccaaccccgtcgccgtggacagatacaacttcgagcaagctgacatctacagggtgagcagctcagtggcctcctccaccaccagcggcgtcaagctgctcaccaccaaggccatctttgatggcatcaacaccaagaatggcctggtgagctacagatatgagaagagcagcaacttcttcaatgagctgaaggacaccatcaccgagctgccggtgcagctctcctcgccgccaacatatggagatgctgagcagtacagccaccgcctcagctatgtttcaaatgctccaacagaatattcttctggaggccacctcatcctcggcctcatccccgtgctgggctggacccacaccagcttgacacaaacaaaccagatccacagcgacagcatcactcagatccccgccgtcaaggtgagcaacctggagagcggcacctccgtggtggccaaccctggcttcactggaggtgatctgctgaagaggacatcaacaggaaggatgggcaccttgaagctcaccgtcgccggcatcctctccagggagatgaccatcaggatcagatatgctgcaacaactgatttcaagctccaggtgatctacaagggcatcctccaatcaagctacaacagcaacaagaccatgaacaaaggagaaaacttgacatatggcaagttcaagttcgccaacttcaccctccccatctccctcctcatcccttcagatctctccattgatgttcagaacctctcctctggagaagaagtctacatcgacaggatcgagttcatccctgttggagcaacatatgaagcagagcag

SEQ ID NO: 259 - DNA, 1995 bp, Artificial Sequence
  synthetic sequence encoding toxin protein
atgtctccaaacaaccaaaatgaatatgagatcattgatgcaacaccaagcacctccgtcagcaatgacagcaccaaatatccatatgcaaatgaaccaacaaatgctcttcaaaacatgaactacaaggactacttgaggatgtcagaaggatatgacaacaagtacttcgccaatccagaagtttttgctgctcctggaggcatcaccaccggcatcaccatcgtcaccaagctgctgggatggctggggctgccatttgctggagaaactggcatggcgctcaacttcatcctcggcctcctctggccaacatcaggaaatccatgggcagagctgatgatcttggtggaggagctcatcaaccaaaaaattgaagaagctgtgaggaacaaggcgctggcagatctggccaactcaggaagggcgctgcaaagctacctcaatgcttttgaagattggcagaagaaccccaacatcttcagaagcaaggagctggtgagagaaagatttgcaaatgctgagcacagcttgaggacagagatgagcagcttcgccatcagaggatttgagattcctctgctggcaacatatgctcaagctgcaaatctacatctcttcctcatcaaggatgttcagatctatggaaaagaatggggctacacccaagctgacattgatctcttctacagggagcaggtggagttcaccaaggagtacacagagcactgcatcaacatctacaatgatggcctcaaccagctgaaaggatcaaatgcaaagcaatggatcgccttcaacaggttcagaagagagatgaccctcaccgtgctggatgtggtggcgctcttcagcaactatgatgtgaggatgtaccccatcaagacaacaacagagctgacaagaaccatctacacagatcctcttggctacaccaaaactggaagctcaagcacgccgccatggtacaactatggaagcagcttcagctacattgagagcgtcgccatccctgctccttctttggtgaaatggctctcacaaattgagatctacagcaagagcgccaaggcgacgccgcagagcgccgactactgggctggccacaccatcacctaccattatggaggagacaatggacaagctgttgcaaattatggagacagaacaaaccccgtcgccgtggacagatacaacttcgagcaagctgacatctacagggtgagctcttcagtggcctcctccaccaccagcggcgtcaagctgctcaccaccaaggccatctttgatggcatcaacaccaagaatggcctggtgagctacagatatgagaagagcagcaacttcttcaatgagctgaaggacaccatcacagagctgccggtgcagctctcctcgccgccaacatatggagatgctgagcagtacagccaccgcctcagctatgtttcaaatgctccaacagaatattcttctggaggccacctcatcctcggcctcatccctgtgctgggctggacccacaccagcttgacacaaacaaaccagatccacagcgacagcatcactcagatccctgctgtcaaggtgagcaacctggagagcggcacctccgtggtggcaaatcctggcttcactggaggtgatctgctgaagaggacatcaacaggaaggatgggcaccttgaagctcaccgtcgccggcatcctctcaagggagatgaccatcaggatcagatatgctgcaacaactgatttcaagctgcaagtgatctacaagggcatcctccaatcaagctacaacagcaacaaaacaatgaacaaaggagaaaatttgacatatggcaagttcaagttcgccaacttcaccctccccatctccttgctcatcccttcagatctctccattgatgttcaaaacctctcttctggagaagaagtttacatcgacaggattgagttcatccctgttggagcaacatatgaagcagaacaa

SEQ ID NO: 260 - DNA, 1878 bp, Artificial Sequence
  synthetic sequence encoding toxin protein
atgaactacaaggactacttgaggatgtcagaaggatatgacaacaagtacttcgccaacccagaagtttttgctgctcctggaggcatcaccaccggcatcaccatcgtcaccaagctgctgggctggctggggctgccatttgctggagaaactggcatggcgctcaacttcatcctcggcctcctctggccaacatcaggaaatccatgggcggagctgatgatcctggtggaggagctcatcaaccaaaagattgaagaagctgtgaggaacaaggcgctggcagatctggccaactcaggccgcgcgctgcaaagctacctcaatgcttttgaagattggcagaagaaccccaacatcttcagaagcaaggagctggtgagagaaagatttgcaaatgctgagcacagcttgaggacagagatgagcagcttcgccatcagaggatttgagatcccgctgctggcaacatatgctcaagctgcaaatctacatctcttcctcatcaaggatgttcagatctatggcaaggaatggggctacacccaagctgacatcgacctcttctacagggagcaggtggagttcaccaaggagtacacagagcactgcatcaacatctacaatgatggcctcaaccagctgaagggctcaaatgccaagcaatggatcgccttcaacaggttcagaagggagatgaccctcaccgtgctggatgtggtggcgctcttcagcaactatgatgtgaggatgtaccccatcaagacaacaacagagctgacaaggaccatctacacagatcctcttggctacaccaagacaggaagctcaagcacgccgccatggtacaactatggaagcagcttcagctacatcgagagcgtcgccatccctgctccttccttggtgaaatggctctcacaaattgagatctacagcaagagcgccaaggcgacgccgcagagcgccgactactgggctggccacaccatcacctaccattatggaggagacaatggccaagctgtagcaaactatggagacaggacaaatcctgttgctgtggacagatacaacttcgagcaagctgacatctacagggtttcaagctccgtcgcctcctccaccaccagcggcgtcaagctgctcaccaccaaggccatctttgatggcatcaacaccaagaatggcctggtgagctacagatatgagaagagcagcaacttcttcaatgagctgaaggacaccatcaccgagctgccggtgcagctctcctcgccgccaacatatggagatgctgagcagtacagccaccgcctcagctatgtttcaaatgctccaacagaatattcttctggaggccacctcatcctcggcctcatccccgtgctgggctggacccacaccagcttgacacaaacaaaccagatccacagcgacagcatcactcagatccccgccgtcaaggtgagcaacctggagagcggcacctccgtggtggccaaccctggcttcactggaggtgatctgctgaagaggacatcaacaggaaggatgggcaccttgaagctcactgttgctggcatcctctccagggagatgaccatcaggatcagatatgctgcaacaactgatttcaagctccaggtgatctacaagggcatcctccaatcaagctacaacagcaacaagaccatgaacaaaggagaaaacttgacatatggcaagttcaagttcgccaacttcaccctccccatctccctcctcatcccttcagatctctccattgatgttcagaacctctcctctggagaagaagtctacatcgacaggatcgagttcatccctgttggagcaacatatgaagcagagcag

SEQ ID NO: 261 - DNA, 1878 bp, Artificial Sequence
  synthetic sequence encoding toxin protein
atgaactacaaggactacttgaggatgtcagaaggatatgacaacaagtacttcgccaatccagaagtttttgctgctcctggaggcatcaccaccggcatcaccatcgtcaccaagctgctgggatggctggggctgccatttgctggagaaactggcatggcgctcaacttcatcctcggcctcctctggccaacatcaggaaatccatgggcagagctgatgatcttggtggaggagctcatcaaccaaaaaattgaagaagctgtgaggaacaaggcgctggcagatctggccaactcaggaagggcgctgcaaagctacctcaatgcttttgaagattggcagaagaaccccaacatcttcagaagcaaggagctggtgagagaaagatttgcaaatgctgagcacagcttgaggacagagatgagcagcttcgccatcagaggatttgagattcctctgctggcaacatatgctcaagctgcaaatctacatctcttcctcatcaaggatgttcagatctatggaaaagaatggggctacacccaagctgacattgatctcttctacagggagcaggtggagttcaccaaggagtacacagagcactgcatcaacatctacaatgatggcctcaaccagctgaaaggatcaaatgcaaagcaatggatcgccttcaacaggttcagaagagagatgaccctcaccgtgctggatgtggtggcgctcttcagcaactatgatgtgaggatgtaccccatcaagacaacaacagagctgacaagaaccatctacacagatcctcttggctacaccaaaactggaagctcaagcacgccgccatggtacaactatggaagcagcttcagctacattgagagcgtcgccatccctgctccttctttggtgaaatggctctcacaaattgagatctacagcaagagcgccaaggcgacgccgcagagcgccgactactgggctggccacaccatcacctaccattatggaggagacaatggacaagctgtagcaaattatggagacagaacaaatcctgttgctgtggacagatacaacttcgagcaagctgacatctacagagtttcaagctccgtcgcctcctccaccaccagcggcgtcaagctgctcaccaccaaggccatctttgatggcatcaacaccaagaatggcctggtgagctacagatatgagaagagcagcaacttcttcaatgagctgaaggacaccatcacagagctgccggtgcagctctcctcgccgccaacatatggagatgctgagcagtacagccaccgcctcagctatgtttcaaatgctccaacagaatattcttctggaggccacctcatcctcggcctcatccctgtgctgggatggacccacaccagcttgacacaaacaaaccagatccattctgacagcatcactcagatccctgctgtcaaggtgagcaacctggagagcggcacctccgtggtggcaaatcctggcttcactggaggtgatctgctgaagaggacatcaacaggaaggatgggcaccttgaagctcactgttgctggcatcctctcaagggagatgaccatcaggatcagatatgctgcaacaactgatttcaagctgcaagtgatctacaagggcatcctccaatcaagctacaacagcaacaaaacaatgaacaaaggagaaaatttgacatatggaaagttcaagttcgccaacttcaccctccccatctccttgctcatcccttcagatctctccattgatgttcaaaacctctcttctggagaagaagtttacatcgacaggattgagttcatccctgttggagcaacatatgaagcagaacaa

SEQ ID NO: 262 - DNA, 1032 bp, Artificial Sequence
  synthetic sequence encoding toxin protein
atgctgattggaaatggcaaggtgttcccaaatgaaagaaggctcttctacatcatgaagaagaacaatgaaaaatatggaccaaatggcatcgtcgaccagaaggagttcatcctcttcaccgagcaatggatctcactgcaaacatatgccatcactggaacaagcctccccatcaatgaagatgagatgaggaagcacatcggcctccgccagaacaccaaatcacctcaatgcttcaagaacctctatgacatccactaccagaacaagcacctctgcacctggtggaacaatgatctggtgccgctgatcctcaagaccatccacaacatcagcagctatggcttcaaatgtgctggaaaaggaacaacaaaaggctactacaaggcgctgcaagctgatctggaaaccatctcattgaaccccaacagcctcacccaggagaaggccttcaaggacttcaagaagagatgccagctgctgcacaaggaagctcttcagtacaagacaacagcagaaaatgctgaaaaatggctcaacatcttctttgaaggaggaaaagatccaaacaacaatgatgtcatcggcgtcgccgccatccaaacacatctaaagaagatcaatgctcatctggacaacaagtaccagaacagcaacagcaagtacaagaggctgctgagcaacatgaaccagctgaagcagagcttggtgaatgccatcaccggcaagcagaacctctccaacaagaaggtgaagaagatgatcattgagatgttccacaagatcaacactcaatcagagaacatcctcaagagcaaaactggcatcatgctgatcttcagaaaaaattcagaaagctggagcgccatcaccaaccacatctccaccttggcctccgcctccgtcaatgagctccagaaggagagcgacaagctctacctggagctgaagaacagcaccaacagctggctggagatcgccacccaaacaaggaacttcgccctcaacctctacaacctcaagacaaca

SEQ ID NO: 263 - DNA, 1032 bp, Artificial Sequence; identical to SEQ ID NO: 262
  synthetic sequence encoding toxin protein

SEQ ID NO: 264 - DNA, 2517 bp, Artificial Sequence
  synthetic sequence encoding toxin protein
atgaacccctacttcaagaacaatgcatatgagatcctggatgatggcaacatgaactaccatccaaaatatcctctcacccagccgctgggctcagagctgcaaaacatccactacaaggactggctggccaccttcccagaaagaaatgacagcatccttggagaaaacagcagcttgagagatggcatcatcacctccaccaacatcattgcctacctcctctcagttcccttccctgctgctggagctgctgctggcatcctcggcgcgctgctgggcttcctctggccaacaaacacccaagctgtttgggaggccttcatggaagctgtggaggcgctgatcgaccagaagatctctgattttgcaagggagcaggccattgcaaggctggaaggcatcaacaaggccatcgagctctaccaaaatgctctctcaaacctggagaagaaccccaacaatgctgtgctgagggagcatgtcagggagcagttcattgccaccaacacctacattgttggaagcatgccgctcttcagagtgaaaggatatgaagttccaatgctcaccatgttcacagaagctgccaacctccacctcctcatcttgagagatgctgccaagtttggagcaagctgggacatggatgtttcaaccatcgagagctaccagcagtacctggagaaggaaactgtcaactacactgattattgtgttggcacctacaatgttgggctggaagaagcaaaaaccctcttcgccgacctctgcgacctgaacacatatccatggacaagatacaaccaaggatggagggaggaggagaagccaaactgctcattgcagcagatcaacagatatgagcagcagctcaatgagcagatcaacagctacagagctgccttcagatattctcctggagaatatcagaagctggagaactggaacctctacaatgccttcagaaggaacatgaccatcatggtgctggatctggtgtcattgtggccaacatacaaccccaagcaatatgtgctgccggtgaaggcagagctgacaagggagatctacaccgacatcagaggaacaacatatcaaagtgatgaaagccagaacacccttcctgtcattgaaggaaggatgatcccgccgccgcgcctcttccaatggctgaggagcttcaccttccacctccaaaatgttcattcagattggacagctggccagatcgccaccggcctccagcaaacagttcaaacaaccttggggccatcacaggtgctgccgctcaccggcgtccaaggaacaagcaccaccagcttcatcccctacattgatggaataacaaggatcgacacccagcaatggtttgagccaagaaggttcaagttctggagcggcggctacatcgagaagaactttggaagcatcgaggagaaatcacccttctgggcagaaggaccaaaatggagggtgtacgagccctcggcgcgcgccaatgagatcctggagcaccgcctcagctggatgacatatgagccggtgaggagcaatgctcccttcgtctacccccagtacaagcagctcggcgcgctggcgctgggctggacccaccaaagtgttgatccagagaacagggtggtttcagacaagatcacccagatccccgccgtcaaggcctactggaacagaggagccttctccgtggtgaagggcagcggcagcactggaggagatctggtgcagctctctccttctggtgaagtctccatcatggtgaagccatcaaggagcggcatcggccagttcagagtgaggatcagatatgctgcaacagcaaatggccgcctcaacatcaagaaatatgttggaagcatccatgcttctcaaagctatgactacaagcaaaccaccaccagcaacctcaccttctccgccttccagtacctggatgtctacaacttcaacctggcagaaacacaatttgaagtttggctgacaaatgaatcaggaggccccatcttcatcgacaagatcgagttcatccccaccacgccgacgccggagccagagcctcaaaatcctcctgttccagaaggaagatatcagatggtgacggcgctcaacaacagcagcatcgtcgacctcaacctctcccaaagatatgttcagatctatggaaatggaaatgctgaaaatcaaaaatggagatttgtttatgatgcttcaaaggatgcctaccagatcatcaatgttgctgctggccaggagctggtgctgagctggttccaatatccagaagaaccagatgctgtcattggagaaccaaacaacaagctcaacaggcagtactggatctttgaagatgctggaaatggctacacatatgtgaggaacatggcagatctaaacagggtgctggatgttccaaatggcaacactggaaatggcacccccatctatgcaagctacttctctggaggaacaaaccagaagttcaagctcaacaagctg

SEQ ID NO: 265 - DNA, 2517 bp, Artificial Sequence
  synthetic sequence encoding toxin protein
atgaacccctacttcaagaacaatgcatatgagatcctggatgatggcaacatgaactaccatccaaaatatcctctcacccagccgctgggctcagagctgcaaaacatccactacaaggactggctggccaccttcccagaaagaaatgacagcatccttggagaaaacagcagcttgagagatggcatcatcacctccaccaacatcattgcctacctcctctcagttcccttccctgctgctggagctgctgctggcatcctcggcgcgctgctgggcttcctctggccaacaaacacccaagctgtttgggaggccttcatggaagctgtggaggcgctgattgatcagaagatctctgattttgcaagggagcaggccattgcaaggctggaaggcatcaacaaggccatcgagctctaccaaaatgctctctcaaatctggagaagaaccccaacaatgctgtgctgagggagcatgtcagggagcagttcattgccaccaacacctacattgttggaagcatgccgctcttcagagtgaaaggatatgaagttccaatgctcaccatgttcacagaagctgccaacctccacctcctcatcttgagagatgctgcaaaatttggagcaagctgggacatggatgtttcaaccatcgagagctaccagcagtacctggagaaggaaactgtcaactacactgattattgtgttggaacatacaatgttgggctggaagaagcaaaaaccctcttcgccgacctctgcgacctgaacacatatccatggacaagatacaaccaaggatggagggaggaggagaagccaaactgctcattgcagcagatcaacagatatgagcagcagctcaatgagcagatcaacagctacagagctgccttcagatattctcctggagaatatcagaagctggagaactggaacctctacaatgccttcagaagaaacatgaccatcatggtgctggatctggtgtcattgtggccaacatacaaccccaagcaatatgtgctgccggtgaaggcagagctgacaagggagatctacaccgacatcagaggaacaacatatcaaagtgatgaaagccaaaacacccttcctgtcattgaaggaaggatgatcccgccgccgcgcctcttccaatggctgaggagcttcaccttccatcttcaaaatgttcattcagattggacagctggccagatcgccaccggcctccagcaaacagttcaaacaacattggggccatcacaagtgctgccgctcaccggcgtccaaggaacaagcaccaccagcttcatcccctacattgatggaataacaaggatcgacacccagcaatggtttgagccaagaagattcaagttctggagcggcggctacattgagaagaactttggaagcatcgaggagaaatcacccttctgggcagaaggaccaaaatggagggtgtatgaaccatcggcgcgcgccaatgagatcctggagcaccgcctcagctggatgacatatgagccggtgagaagcaatgctcccttcgtctatcctcagtacaagcagctcggcgcgctggcgctgggctggacacatcaaagtgttgatccagaaaacagggtggtttcagacaagatcacccagatccccgccgtcaaggcctactggaacagaggagccttctccgtggtgaagggcagcggcagcactggaggagatctggtgcagctctctccttctggtgaagtttccatcatggtgaagccatcaagaagcggcatcggccagttcagagtgaggatcagatatgctgcaacagcaaatggaaggctcaacatcaagaaatatgttggaagcatccatgcttctcaaagctatgactacaagcaaacaacaaccagcaacctcaccttctccgccttccagtacctggatgtctacaacttcaaccttgctgaaacacaatttgaagtttggctgacaaatgaatcaggaggccccatcttcatcgacaagattgagttcatccccaccacgccgacgccggagccagaacctcaaaatcctcctgttccagaaggaagatatcagatggtgacggcgctcaacaacagcagcatcgtcgacctcaacctctcccaaagatatgttcagatctatggaaatggaaatgctgaaaatcaaaaatggagatttgtttatgatgcttcaaaagatgcctaccagatcatcaatgttgctgctggccaggagctggtgctgagctggttccaatatccagaagaaccagatgctgtcattggagaaccaaacaacaagctcaacaggcagtactggatctttgaagatgctggaaatggctacacatatgtgaggaacatggcagatctaaacagggtgctggatgttccaaatggcaacactggaaatggaacccccatctatgcaagctacttctctggaggaacaaaccagaagttcaagctcaacaagctg

SEQ ID NO: 266 - DNA, 1935 bp, Artificial Sequence
  synthetic sequence encoding toxin protein
atggaccagcaaaatgaatatgagatcatccaagctggcgtcagcaatgccatcaccgacaccttccaaagatatcctctggccaacaaccccaacaccagcttccagaacatgaactacaaggactacctcaatgatccaatgttccttggagaaacaagagatgctcaaacagccatcaccaccagcttggagatcatctcagagatcctcggcttcctcggcgtccccttcgtcggccccatcatcggcttcaccaacaggctgatcaacctcctctggccaaggaacaccaccgacatctggaatgccttcatggatgaagttcaagctctcatcaatgaaagcatcaccaaggccgtcagaagcaaggccatctccgagctggaaggcatccaccaggtgtacaggctctacattgaagctctaaatgaatggaaggacacgccggacaaccccttcgtccaagaaagggtgaggaccaccttcagagatgtcaacagcatcatcaactacgccatgccctccttcagagttcaaggatttgagatcccgctgctggtggtgtatgctcaagctgccaacctccacctggtgctgctgagagatgcaacattatttggagctggatggggcttcacagaaacaaacatcaatgacagatacaatgagcaggtgcgcgtcaccaatggctacatcgaccactgcaccaaatggtacaatgaaggcctcaccaggctgaagaacaactggtcaaagtaccaccagttcagaagggagatgaccttgatggtgctggacctcattgctctcttccccagccatgatgcaagaagatatccaatggaaacttctgctcagctgacaagagatgtctacacagatccaattggctacagaggaaatgccaacttctcagatccatggaccaaccatgtcagcttctccaaggcagaatcagaaaccatcaggccgccgcacctcttcgacaccttggagagcgtggagatcaacaccgccaaggccatgctgccgctgaatgacaagagctacatgtactactgggctggccacaccgtcaccagcaggctgctggacagcagcggcaacccgctgaagtacacatatggaagcatgacatcagagaagaacctggtttctcttcctggcaaggatgtctacaggatcaacagcgtcgcctccggcttcagcaactactatgctaagctctatggagtgagcaaggtggacttctccatcgtggacaggaacaacagcaacaagaccacctacagctacagcaagagcagcaccgtgccatcagacaacaaggagaacagagattcagaaaatgagctgcctcaaacaacaacagatcaaccagactacaagggctacagccaccgcctgagccacatcaccttcatctcctccgccatcccaacatatgtttggacaaggaagagcgccgacctcaccaacaccatctaccctgacaagatcacccagatccctgctgtgaagatgtacgagctgggaagctcagctgtggtggtgaaggggccaggcttcactggaggagatctggtgaagaggaccaacaatggaagccttggaaggttcaagatcaccattgattctcctggagctcaccgctaccgcctccgcgtcagatatcattcagatgtctccggcgtgttccacatgcaaatcaacaatgtggaaaccatccaaggagagttcaagagcaccgtggacagcacctccaccatgtcaaatgacagcttccagctgagggagttcaccaccaccttccgcttcccaagcaatgtcaccgacatcaaggtgagcctcggcgccatcaatggccaaggaaacttctacctggacaggattgaatttgctcctgtggacaccaactatgatgaaaggatc

SEQ ID NO: 267 - DNA, 1935 bp, Artificial Sequence
  synthetic sequence encoding toxin protein
atggaccagcaaaatgaatatgagatcatccaagctggtgtcagcaatgccatcaccgacaccttccaaagatatcctctggccaacaaccccaacaccagcttccagaacatgaactacaaggactacctcaatgatccaatgttccttggagaaacaagagatgctcaaacagccatcaccaccagcttggagatcatctcagagatccttggcttcctcggcgtccccttcgtcggccccatcattggcttcaccaacaggctgatcaacctcctctggccaaggaacaccaccgacatctggaatgccttcatggatgaagttcaagctctcatcaatgaaagcatcaccaaggccgtcagaagcaaggccatctcagagctggaaggcatccaccaggtgtacaggctctacattgaagctctaaatgaatggaaggacacgccggacaacccctttgttcaagaaagggtgaggacaaccttcagagatgtcaacagcatcatcaactatgccatgccatccttcagagttcaaggatttgagattcctctgctggtggtgtatgctcaagctgccaacctccatctggtgctgctgagagatgcaacattatttggagctggatggggcttcacagaaacaaacatcaatgacagatacaatgagcaggtgcgcgtcaccaatggctacatcgaccactgcaccaaatggtacaatgaaggcctcacaaggctgaagaacaactggtcaaagtaccaccagttcagaagagagatgacattgatggtgctggacctcattgctctcttcccaagccatgatgcaagaagatatccaatggaaacttctgctcagctgacaagagatgtctacacagatccaattggctacagaggaaatgcaaacttctcagatccatggacaaatcatgtcagcttctccaaggcagaatcagaaaccatcaggccgccgcacctcttcgacaccttggagagcgtggagatcaacaccgccaaggccatgctgccgctgaatgacaagagctacatgtactactgggctggccacaccgtcaccagcaggctgctggacagcagcggcaaccctctcaagtacacatatggaagcatgacatcagagaagaacctggtttctcttcctggaaaagatgtctacaggatcaacagcgtcgcctctggcttcagcaactactatgctaagctctatggagtgagcaaggtggacttctccatcgtggacaggaacaacagcaacaagacaacatacagctacagcaagagcagcaccgtgccatcagacaacaaggagaacagagattcagaaaatgagcttcctcaaacaacaacagatcaaccagattacaagggctacagccaccgcctgagccacatcaccttcatctcctccgccatcccaacatatgtttggacaaggaagagcgccgacctcaccaacaccatctatccagacaagatcacccagattcctgctgtgaagatgtatgagctgggaagctcagctgtggtggtgaaggggccaggcttcactggaggagatctggtgaagaggacaaacaatggaagccttggaagattcaagatcaccattgattctcctggagctcaccgctacaggctccgcgtcagatatcattcagatgtctccggcgtgttccacatgcaaatcaacaatgtggaaaccatccaaggagagttcaagagcaccgtggacagcacctccaccatgtcaaatgacagcttccagctgagggagttcaccaccaccttcagattcccaagcaatgtcaccgacatcaaggtgagcctcggcgccatcaatggacaaggaaacttctacctggacaggattgaatttgctcctgtggacaccaactatgatgaaaggatc

SEQ ID NO: 268 - DNA, 1824 bp, Artificial Sequence
  synthetic sequence encoding toxin protein
atgaactacaaggactacctcaatgatccaatgttccttggagaaacaagagatgctcaaacagccatcaccaccagcttggagatcatctcagagatcctcggcttcctcggcgtccccttcgtcggccccatcatcggcttcaccaacaggctgatcaacctcctctggccaaggaacaccaccgacatctggaatgccttcatggatgaagttcaagctctcatcaatgaaagcatcaccaaggccgtcagaagcaaggccatctccgagctggaaggcatccaccaggtgtacaggctctacattgaagctctaaatgaatggaaggacacgccggacaaccccttcgtccaagaaagggtgaggaccaccttcagagatgtcaacagcatcatcaactacgccatgccctccttccgcgtccaaggatttgagatcccgctgctggtggtgtatgctcaagctgccaacctccacctggtgctgctgagagatgcaacattatttggagctggatggggcttcacagaaacaaacatcaatgacagatacaatgagcaggtgcgcgtcaccaatggctacatcgaccactgcaccaaatggtacaatgaagggctgacaaggctgaagaacaactggtcaaagtaccaccagttcagaagggagatgaccttgatggtgctggacctcattgctctcttccccagccatgatgcaagaagatatccaatggaaacttctgctcagctgacaagagatgtctacacagatccaattggctacagaggaaatgccaacttctcagatccatggaccaaccatgtcagcttctccaaggcagaatcagaaaccatcaggcctcctcatctcttcgacaccttggagagcgtggagatcaacaccgccaaggccatgctgccgctgaatgacaagagctacatgtactactgggctggccacaccgtcaccagcaggctgctggacagctcaggaaatcctctcaagtacacatatggaagcatgacatctgagaagaacctggtttctcttcctggcaaggatgtctacaggatcaacagcgtcgcctcaggcttcagcaactactacgccaagctctatggagtgagcaaggtggacttctccatcgtggacaggaacaacagcaacaagaccacctacagctacagcaagagcagcactgttccttctgacaacaaggagaacagagattcagaaaatgagctgcctcaaacaacaacagatcaaccagactacaagggctacagccaccgcctgagccacatcaccttcatctcctccgccatcccaacatatgtttggacaaggaagagcgccgacctcaccaacaccatctaccctgacaagatcacccagatccctgctgtgaagatgtacgagctgggaagctcagctgtggtggtgaaggggccaggcttcactggaggagatctggtgaagaggaccaacaatggaagccttggaaggttcaagatcaccattgattctcctggagctcaccgctacaggctgagggtgagatatcattcagatgtctccggcgtgttccacatgcaaatcaacaatgtggaaaccatccaaggagagttcaagagcaccgtggacagcacctccaccatgtcaaatgacagcttccagctgagggagttcaccaccaccttccgcttcccaagcaatgtcaccgacatcaaggtgagcctcggcgccatcaatggccaaggaaacttctacctggacaggatcgagttcgcgccggtggacaccaactatgatgaaaggatc

SEQ ID NO: 269 - DNA, 1824 bp, Artificial Sequence
  synthetic sequence encoding toxin protein
atgaactacaaggactacctcaatgatccaatgttccttggagaaacaagagatgctcaaacagccatcaccaccagcttggagatcatctcagagatccttggcttcctcggcgtccccttcgtcggccccatcattggcttcaccaacaggctgatcaacctcctctggccaaggaacaccaccgacatctggaatgccttcatggatgaagttcaagctctcatcaatgaaagcatcaccaaggccgtcagaagcaaggccatctcagagctggaaggcatccaccaggtgtacaggctctacattgaagctctaaatgaatggaaggacacgccggacaacccctttgttcaagaaagggtgaggacaaccttcagagatgtcaacagcatcatcaactatgccatgccatccttccgcgtccaaggatttgagattcctctgctggtggtgtatgctcaagctgccaacctccatctggtgctgctgagagatgcaacattatttggagctggatggggcttcacagaaacaaacatcaatgacagatacaatgagcaggtgcgcgtcaccaatggctacatcgaccactgcaccaaatggtacaatgaagggctgacaaggctgaagaacaactggtcaaagtaccaccagttcagaagagagatgacattgatggtgctggacctcattgctctcttcccaagccatgatgcaagaagatatccaatggaaacttctgctcagctgacaagagatgtctacacagatccaattggctacagaggaaatgcaaacttctcagatccatggacaaatcatgtcagcttctccaaggcagaatcagaaaccatcaggcctcctcatctcttcgacaccttggagagcgtggagatcaacaccgccaaggccatgctgccgctgaatgacaagagctacatgtactactgggctggccacaccgtcaccagcaggctgctggacagctcaggaaatcctctcaagtacacatatggaagcatgacatctgagaagaacctggtttctcttcctggaaaagatgtctacaggatcaacagcgtcgcctcaggcttcagcaactactatgccaagctctatggagtgagcaaggtggacttctccatcgtggacaggaacaacagcaacaagacaacatacagctacagcaagagcagcactgttccttctgacaacaaggagaacagagattcagaaaatgagcttcctcaaacaacaacagatcaaccagattacaagggctacagccaccgcctgagccacatcaccttcatctcctccgccatcccaacatatgtttggacaaggaagagcgccgacctcaccaacaccatctatccagacaagatcacccagattcctgctgtgaagatgtatgagctgggaagctcagctgtggtggtgaaggggccaggcttcactggaggagatctggtgaagaggacaaacaatggaagccttggaagattcaagatcaccattgattctcctggagctcaccgctacaggctgagggtgagatatcattcagatgtctccggcgtgttccacatgcaaatcaacaatgtggaaaccatccaaggagagttcaagagcaccgtggacagcacctccaccatgtcaaatgacagcttccagctgagggagttcaccaccaccttcagattcccaagcaatgtcaccgacatcaaggtgagcctcggcgccatcaatggacaaggaaacttctacctggacaggattgagttcgcgccggtggacaccaactatgatgaaaggatc

SEQ ID NO: 270 - DNA, 2001 bp, Artificial Sequence
  synthetic sequence encoding toxin protein
atgaacaagaactacctctccaagagccaagatctcacccagatctcagagatctttggatatgatcccatccatcctctggtgaaccccaagaaccacatcgagagcctccgcgtcaacagaaatgagctgaggacgctgccagaaggcttcgcctcctcaacagagagcgccatcaccaacaccctcaacatcatctccatcctgctggatgcttctggtcatccggcggcggcgcgcgtcctcggcgtcatcaccggcatcatcggcatcctctggcctggaggatcacaaaaaacatgggaggagttcatggccgccgtggaggcgctgattgatgagaagatcacagagagcttcaagaatgaagccatcagcaagctcaatggcctcgccgacctctacaccgtctacctctccgagctggagctctggctggagcatcctcatgatccaagcatcatccagagcgtcaggacaaggttcctggatctggattcagagttcatctcctccatgccgcagttcgccatctccggcttcgaggtgagcttccttcctgtttatgctcaagctgccaacctccacctgctgctgctgagagatctctcatattatggaaatgattggggcctccagcagccagagattgagaactactacaacaggcagatcaacaacatccagaagtacacagatcactgcgtcaaatggtatcagctgggcctccaagatgtctacaacaagtacaactcaaccatcatcaatgaagatggagggctgccatggacccactacaacagatacaggagggagatgaccatcctggtgctggatctggtggccaccttctccaccaatgattggaagaagtactacctggaaacaaatgtggagctcagcagggagatctacacagatcctcttggatatgaagattctgatgaaggaaacatcactgatgtggactggtattcagaaggagtttccttctccaccatcgagaacctccattctccaaagctggtggaatggctgaagaggatcaccatccaaacagattacttctccgccggctcagatgaaagctactgctgggctggccactacatctacaccaccttcaccgacagcgacaaggagtacagcagatattatggaaatccagaaaatgtagagagcaccaccagctacacctttgctccagcagaggtgtacaaggtggagagcgtggtgggctcagaaagaaatgcaacatatgacaactatgtcaacagcgccaacaccttctaccaggtgacgccaacaaatgagctgaagaagttcatctacagctacagaaatgattatgacaagaaaaccctctactctgatgatcagctgccgctggagacagatcctccaaaatatggagaatacagccaccgcctctccaacatcacctgcgcgccgctcaactcagatgattttgggctggtgcccatcctcggctggacccacaccagcttgaagagggagaacatcatctaccctgacaagatcacccagatccccgccgtcaagagcttctccacagaaggaacatgggagagggtggctgctggacctggcttcactggaggaaatgtcacacaagcaacaaacaccgtcacctcaggcatcaagacaacagatctggtgaagatcagggtgaggattgacagcaccgccagcagcaagcagtacagggtgaggctgagatatgcttcaaatcaagatttcagccatgctcacttctacactggaactggaagcaatgaaacaaccttctccttgaagaaaacaacagatttccccttcgccaactacaacagctttggatatgtggagatcccaagggtgctgaagttctcctctggatcagagatcatcaatgtttatgtttatccagaaaatggcctcaaggtgcaagtggacaagatcgagttcatccctgttgatgacaactatgaagatcgcgtc

SEQ ID NO: 271 - DNA, 2001 bp, Artificial Sequence
  synthetic sequence encoding toxin protein
atgaacaagaactacctctccaagagccaagatctcacccagatctcagagatctttggatatgatcccatccatcctctggtgaaccccaagaaccacattgaaagcctccgcgtcaacagaaatgagctgaggacgctgccagaaggcttcgcctcctcaacagaaagcgccatcaccaacaccctcaacatcatctccatcctgctggatgcttctggtcatccggcggcggcgcgcgtcctcggcgtcatcaccggcatcatcggcatcctctggcctggaggatcacaaaaaacatgggaggagttcatggccgccgtggaggcgctgattgatgagaagatcacagagagcttcaagaatgaagccatcagcaagctcaatggcctcgccgacctctacaccgtctacctctcagagctggagctctggctggagcatcctcatgatccaagcatcatccagagcgtcaggacaaggttcctggatctggattcagagttcatctcctccatgccgcagttcgccatctctggcttcgaggtgagcttccttcctgtttatgctcaagctgccaacctccacctgctgctgctgagagatctttcatattatggaaatgattggggcctccagcagccagaaattgagaactactacaacaggcagatcaacaacatccagaagtacacagatcactgcgtcaaatggtatcagctgggcctccaagatgtctacaacaagtacaactcaaccatcatcaatgaagatggagggctgccatggacccactacaacagatacagaagagagatgaccatcctggtgctggatctggtggccaccttctccaccaatgattggaagaagtactacctggaaacaaatgtggagctcagcagggagatctacacagatcctcttggatatgaagattctgatgaaggaaacatcactgatgttgattggtattcagaaggagtttccttctccaccatcgagaacctccattctccaaagctggtggaatggctgaagaggatcaccatccaaacagattacttctccgccggctcagatgaaagctactgctgggctggccactacatctacaccaccttcaccgacagcgacaaggagtacagcagatattatggaaatccagaaaatgtagaaagcaccaccagctacacctttgctccagcagaggtgtacaaggtggagagcgtggtgggctcagaaagaaatgcaacatatgacaactatgtcaacagcgccaacaccttctaccaggtgacaccaacaaatgagctgaagaagttcatctacagctacagaaatgattatgacaagaaaaccctctactctgatgatcagctgccgctggaaacagatcctccaaaatatggagaatacagccaccgcctctccaacatcacctgcgcgccgctcaactcagatgattttgggctggtgcccatccttggatggacccacaccagcttgaagagggagaacatcatctaccctgacaagatcacccagatccccgccgtcaagagcttctccacagaaggaacatgggagagggtggctgctggacctggcttcactggaggaaatgtcacacaagcaacaaacaccgtcacctcaggcatcaagacaacagatctggtgaagatcagggtgaggattgacagcaccgccagcagcaagcagtacagggtgaggctgagatatgcttcaaatcaagatttcagccatgctcacttctacactggaactggaagcaatgaaacaaccttctccttgaagaaaacaacagatttccccttcgccaactacaacagctttggatatgtggagatcccaagggtgctgaagttctcctctggatcagagatcatcaatgtttatgtttatccagaaaatggcctcaaggtgcaagtggacaagatcgagttcatccctgttgatgacaactatgaagatcgcgtc

SEQ ID NO: 272 - DNA, 1689 bp, Artificial Sequence
  synthetic sequence encoding toxin protein
atggccgccgtggaggcgctgattgatgagaagatcacagagagcttcaagaatgaagccatcagcaagctcaatggcctcgccgacctctacaccgtctacctctccgagctggagctctggctggagcatcctcatgatccaagcatcatccagagcgtcaggacaaggttcctggatctggattcagagttcatctcctccatgccgcagttcgccatctccggcttcgaggtgagcttccttcctgtttatgctcaagctgccaacctccacctgctgctgctgagagatctctcatattatggaaatgattggggcctccagcagccagagattgagaactactacaacaggcagatcaacaacatccagaagtacacagatcactgcgtcaaatggtatcagctgggcctccaagatgtctacaacaagtacaactcaaccatcatcaatgaagatggagggctgccatggacccactacaacagatacaggagggagatgaccatcctggtgctggatctggtggccaccttctccaccaatgattggaagaagtactacctggaaacaaatgtggagctcagcagggagatctacacagatcctcttggatatgaagattctgatgaaggaaacatcactgatgtggactggtattcagaaggagtttccttctccaccatcgagaacctccattctccaaagctggtggaatggctgaagaggatcaccatccaaacagattacttctctgctggatcagatgaaagctactgctgggctggccactacatctacaccaccttcaccgacagcgacaaggagtacagcagatattatggaaatccagaaaatgtagagagcaccaccagctacaccttcgcgccggcggaggtgtacaaggtggagagcgtggtgggctcagaaagaaatgcaacatatgacaactatgtcaacagcgccaacaccttctaccaggtgacgccaacaaatgagctgaagaagttcatctacagctacagaaatgattatgacaagaaaaccctctactcagatgatcagctgccgctggagacagatcctccaaaatatggagaatacagccaccgcctctccaacatcacctgcgcgccgctcaactctgatgattttgggctggtgcccatcctcggctggacccacacttccttgaagagggagaacatcatctaccctgacaagatcacccagatccctgctgtgaagagcttctcaacagaaggaacatgggagagggtggctgctggacctggcttcactggaggaaatgtcacacaagcaacaaacaccgtcaccagcggcatcaagacaacagatctggtgaagatcagggtgaggattgacagcaccgccagcagcaagcagtaccgcgtccgcctcagatatgcttcaaatcaagatttcagccatgctcacttctacactggaactggaagcaatgaaacaaccttctccttgaagaaaacaacagatttccccttcgccaactacaacagctttggatatgtggagatcccaagggtgctgaagttctcctctggatcagagatcatcaatgtttatgtttatccagaaaatggcctcaaggtgcaagtggacaagatcgagttcatccctgttgatgacaactatgaagatcgcgtc

SEQ ID NO: 273 - DNA, 1689 bp, Artificial Sequence; identical to SEQ ID NO: 272
  synthetic sequence encoding toxin protein

SEQ ID NO: 274 - DNA, 1974 bp, Artificial Sequence
  synthetic sequence encoding toxin protein
atgtcgccaaacaaccaaaatgaatatgagatcaaggatgcaacaccaagcacctccgtcagctcagattcagcaagatatccatttgcaaatgagccaacaaatgctctccagaacatgaactacaaggagtacctgaggatgtcagaaggccatgatgctgcctacttcagcaacccagaagcatttgtggacaccaagagcatccaggccatcatcaatgtcatcggcaaggcgctgggagctcttggagttcctggagctggcatcattgcttccttctacagcttcatcgtcggccagctctggccaagcaacagcgtcagcttatgggagcagatcatggagcaggtggaggagctgattgatcagaagatcacagaatatgcaaggaacaaggcgctgacagagctgaagggccttggagatgctctggatgtttatcaagaaagcctggaagcatggctggagaacagaaatgacacaagagcaaggagcgtggtgtcaaagcagttcattgctctggagctggacttcgtcggcgccatcccctccttcgccgtgtcaaaccaggaggtgccgctgctggccgtctatgctcaagctgccaacctccacctgctgctgctgagagatgcttccatcttcggcgccgactggggcttctcctcctctgagatctccacctactacaacaggcaggtgcgcctcaccagccagtacagcgactactgcgtcaaatggtacaacaccggcctggacaagctgaaaggaacaaattcagcaagctggctgaagtaccaccagttcagaagggagatgaccttgatggtgctggatgtggtggcgctcttccccaactacaacacccaaacatatccaattgaaacaagagctcagctgacaagagatgtctacacagatcctgctgccttcaacaatgtttcagattatggcttctgcaacccatggagcacccacagcggcatcctcttctctgaggtggagaatgctgtgatcagaagcccccacctcttcgacatcctctcaagcatcgagatcaacaccgcgcgcggcggcattgctctcaacaacaccgcctacatcaactactggagcggccacagcttgaagtaccatgaaacaaacaaccccaccatccgcgccgtcaactatggaaggatcacctcagagaagaacagcttggtgctggaggacagggagatctttgaaaccatctccgtggtggccaacctggcaaatgtctaccagaaggcatatggagttccagaaagctacttcaacatgacaagaagaggaacaagcagcaccagctactacttctacagcaagacccacaccacgccatatggctgctcagatgtttatccaagctacagcgacatccccatcgacagaaatgttcctgttgctgaaagctacagccaccgcctgagccacatcaccttccacagcttctcaaagaacagcaatgccatctatggcagcttccctgtttttgtttggacccatgtctccgccgacctcaccaacaccatctaccctgatgccatcacccagctgcccatggtgaaggcaaatgctctcctctcaggaacctccgtcatcaaggggccaggaagcaccggcggcgacatcttgaggaggacctccgtcggccgcgtcggcaacttcaaggtgaatgttaatgggccgctcacccaaagatatctggtgaggatcagatatgcttcaacaacagatctggacttctatgtctacagaggaggcaccaccgtcagcaactacaggttcaacaagaccatgaacaaaggagcttccttgacatatgacatcttcaagttcgcctccttctccacccccttcaccttcaccaagacacaagatgagctgggcatctccatccagaacttctcctctggagaagaagtctacatcgacaggattgaagtt

SEQ ID NO: 275 - DNA, 1974 bp, Artificial Sequence
  synthetic sequence encoding toxin protein
atgtctccaaacaaccaaaatgaatatgagatcaaggatgcaacaccaagcacctccgtcagctcagattcagcaagatatccatttgcaaatgaaccaacaaatgctcttcaaaacatgaactacaaggagtacttgaggatgtcagaaggacatgatgctgcatacttcagcaatccagaagcatttgtggacaccaagagcatccaagccatcatcaatgtcatcggcaaggctcttggagctcttggagttcctggagctggcatcattgcttccttctacagcttcatcgtcggccagctctggccaagcaacagcgtcagcttatgggagcagatcatggagcaggtggaggagctgattgatcagaagatcacagaatatgcaaggaacaaggcgctgacagagctgaagggccttggagatgctcttgatgtttatcaagaaagcctggaagcatggctggagaacagaaatgacacaagagcaagaagcgtggtttcaaagcagttcattgctctggagctggacttcgtcggcgccatcccttccttcgccgtgtcaaatcaagaggtgccgctgctggctgtttatgctcaagctgccaacctccatctgctgctgctgagagatgcttccatcttcggcgccgactggggcttctcctcctctgagatctccacctactacaacaggcaggtgaggctcaccagccagtacagcgactactgcgtcaaatggtacaacactgggctggacaagctgaaaggaacaaattcagcaagctggctgaagtaccaccagttcagaagagagatgacattgatggtgctggatgtggtggcgctcttccccaactacaacacccaaacatatccaattgaaacaagagctcagctgacaagagatgtctacacagatcctgctgccttcaacaatgtttcagattatggcttctgcaatccatggagcacccacagcggcatcctcttctctgaggtggaaaatgctgtgatcagaagccctcatctcttcgacatcctctcaagcattgagatcaacaccgcgcgcggcggcattgctctcaacaacaccgcctacatcaactactggagcggccacagcttgaagtaccatgaaacaaacaaccccaccatccgcgccgtcaactatggaaggatcacctcagagaagaacagcttggtgctggaggacagggagatctttgaaaccatctccgtggtggccaacctggcaaatgtctaccagaaggcatatggagttccagaaagctacttcaacatgacaagaagaggaacaagcagcaccagctactacttctacagcaagacccacaccacgccatatggctgctcagatgtttatccaagctacagcgacatccccatcgacagaaatgttcctgttgctgaaagctacagccaccgcctgagccacatcaccttccacagcttctcaaagaacagcaatgccatctatggcagcttccctgtttttgtttggacacatgtctccgccgacctcaccaacaccatctatcctgatgccatcacccagctgccaatggtgaaggcaaatgctctcctctcaggaacttctgtcatcaaaggaccaggaagcaccggcggcgacatcttgaggaggacctccgtcggccgcgtcggcaacttcaaggtgaatgttaatgggccgctcacccaaagatatttggtgaggatcagatatgcttcaacaacagatctggacttctatgtctacagaggaggaaccaccgtcagcaactacaggttcaacaagacaatgaacaaaggagcttccttgacatatgacatcttcaagtttgcttccttctccacccccttcaccttcaccaagacacaagatgagctgggcatctccatccagaacttctcttctggagaagaagtttacatcgacaggattgaagtt

SEQ ID NO: 276 - DNA, 1932 bp, Artificial Sequence
  synthetic sequence encoding toxin protein
atgccaagcacctccgtcagctcagattcagcaagatatccatttgcaaatgagccaacaaatgctctccagaacatgaactacaaggagtacctgaggatgtcagaaggccatgatgctgcctacttcagcaacccagaagcatttgtggacaccaagagcatccaggccatcatcaatgtcatcggcaaggcgctgggagctcttggagttcctggagctggcatcattgcttccttctacagcttcatcgtcggccagctctggccaagcaacagcgtcagcttatgggagcagatcatggagcaggtggaggagctgattgatcagaagatcacagaatatgcaaggaacaaggcgctgacagagctgaagggccttggagatgctctggatgtttatcaagaaagcctggaagcatggctggagaacagaaatgacacaagagcaaggagcgtggtgtcaaagcagttcattgctctggagctggacttcgtcggcgccatcccctccttcgccgtgtcaaaccaggaggtgccgctgctggccgtctatgctcaagctgccaacctccacctgctgctgctgagagatgcttccatcttcggcgccgactggggcttctcctcctctgagatctccacctactacaacaggcaggtgcgcctcaccagccagtacagcgactactgcgtcaaatggtacaacaccggcctggacaagctgaaaggaacaaattcagcaagctggctgaagtaccaccagttcagaagggagatgaccttgatggtgctggatgtggtggcgctcttccccaactacaacacccaaacatatccaattgaaacaagagctcagctgacaagagatgtctacacagatcctgctgccttcaacaatgtttcagattatggcttctgcaacccatggagcacccacagcggcatcctcttctctgaggtggagaatgctgtgatcagaagcccccacctcttcgacatcctctcaagcatcgagatcaacaccgcgcgcggcggcattgctctcaacaacaccgcctacatcaactactggagcggccacagcttgaagtaccatgaaacaaacaaccccaccatccgcgccgtcaactatggaaggatcacctcagagaagaacagcttggtgctggaggacagggagatctttgaaaccatctccgtggtggccaacctggcaaatgtctaccagaaggcatatggagttccagaaagctacttcaacatgacaagaagaggaacaagcagcaccagctactacttctacagcaagacccacaccacgccatatggctgctcagatgtttatccaagctacagcgacatccccatcgacagaaatgttcctgttgctgaaagctacagccaccgcctgagccacatcaccttccacagcttctcaaagaacagcaatgccatctatggcagcttccctgtttttgtttggacccatgtctccgccgacctcaccaacaccatctaccctgatgccatcacccagctgcccatggtgaaggcaaatgctctcctctcaggaacctccgtcatcaaggggccaggaagcaccggcggcgacatcttgaggaggacctccgtcggccgcgtcggcaacttcaaggtgaatgttaatgggccgctcacccaaagatatctggtgaggatcagatatgcttcaacaacagatctggacttctatgtctacagaggaggcaccaccgtcagcaactacaggttcaacaagaccatgaacaaaggagcttccttgacatatgacatcttcaagttcgcctccttctccacccccttcaccttcaccaagacacaagatgagctgggcatctccatccagaacttctcctctggagaagaagtctacatcgacaggattgaagtt

SEQ ID NO: 277 - DNA, 1932 bp, Artificial Sequence
  synthetic sequence encoding toxin protein
atgccaagcacctccgtcagctcagattcagcaagatatccatttgcaaatgaaccaacaaatgctcttcaaaacatgaactacaaggagtacttgaggatgtcagaaggacatgatgctgcatacttcagcaatccagaagcatttgtggacaccaagagcatccaagccatcatcaatgtcatcggcaaggctcttggagctcttggagttcctggagctggcatcattgcttccttctacagcttcatcgtcggccagctctggccaagcaacagcgtcagcttatgggagcagatcatggagcaggtggaggagctgattgatcagaagatcacagaatatgcaaggaacaaggcgctgacagagctgaagggccttggagatgctcttgatgtttatcaagaaagcctggaagcatggctggagaacagaaatgacacaagagcaagaagcgtggtttcaaagcagttcattgctctggagctggacttcgtcggcgccatcccttccttcgctgtttcaaatcaagaggtgccgctgctggctgtttatgctcaagctgcaaacctccatctgctgctgctgagagatgcttccatcttcggcgccgactggggcttctcctcctctgagatctccacctactacaacaggcaagttcggctcaccagccagtacagcgactactgcgtcaaatggtacaacactgggctggacaagctgaaaggaacaaattcagcaagctggctgaagtaccaccagttcagaagagagatgacattgatggtgctggatgtggtggcgctcttccccaactacaacacccaaacatatccaattgaaacaagagctcagctgacaagagatgtctacacagatcctgctgccttcaacaatgtttcagattatggcttctgcaatccatggagcacccacagcggcatcctcttctctgaggtggaaaatgctgtgatcagaagccctcatctcttcgacatcctctcaagcattgagatcaacaccgcgcgcggcggcattgctctcaacaacaccgcctacatcaactactggagcggccacagcttgaagtaccatgaaacaaacaaccccaccatccgcgccgtcaactatggaaggatcacctcagagaagaacagcttggtgctggaggacagggagatctttgaaaccatctccgtggtggccaacctggcaaatgtctaccagaaggcatatggagttccagaaagctacttcaacatgacaagaagaggaacaagcagcaccagctactacttctacagcaagacccacaccacgccatatggctgctcagatgtttatccaagctacagcgacatccccatcgacagaaatgttcctgttgctgaaagctacagccaccgcctgagccacatcaccttccacagcttctcaaagaacagcaatgccatctatggcagcttccctgtttttgtttggacacatgtctccgccgacctcaccaacaccatctatcctgatgccatcacccagctgccaatggtgaaggcaaatgctcttctctcaggaacttctgtcatcaaaggaccaggaagcaccggcggcgacatcttgaggaggacctccgtcggccgcgtcggcaacttcaaggtgaatgttaatgggccgctgacacaaagatatttggtgaggatcagatatgcttcaacaacagatctggacttctatgtctacagaggaggaaccaccgtcagcaactacaggttcaacaagacaatgaacaaaggagcttccttgacatatgacatcttcaagtttgcttccttctccacccccttcaccttcaccaagacacaagatgagctgggcatctccatccagaacttctcttctggagaagaagtttacatcgacaggattgaagtt

SEQ ID NO: 278 - DNA, 1992 bp, Artificial Sequence
  synthetic sequence encoding toxin protein
atgacaaggaacaggcaagatgaatatgagatcattgatgcaagcaactgcggctgcgcctctgatgatgtcaacagatatcctcttgcttcagatccaaatgctgctctccagaacatcaactacaaggagtacctccagatgacagaaggagactacaccgacagcaacatctctccttccttcatctcaggaagagatgtgctgcaaactggcattgacattgttggaaggatcttgggcttcatcggcgtccccttcgtcggccagattgttggcttctacaccttcctcctcaaccagctctggccaacaaatgacaatgctgtttgggaggccttcatggcgcagatcgaggagctgatcaaccagaggatctcagaagctgtggtgggcctcgccgccgacaacctcaccggcctccacaacaactatgatctctatgtagaagctctggaagaatggctggagaggccaaatggcgcgcgcgcctccttggtgttccagaggttcaatgtgctggatggcctcttcacccagttcatgccctcctttggaactggacctggatcaaggaactatgctgttcctctgctgaatgtctacacccaagctgccaacctccacctgctgctgctgaaggatgctgagatctatggagaaagatggggcctcaaccaaacccagatcaacagcttccacacaaggcagcagaacttgacaagggactacaccaaccactgcgtcaccacctacaacagcggcctggaccgcctccgcggcaccaatgcaacatcatgggccaactaccaccagtacaggagggagatgaccttgatggtgcttgatctggtcaccctcttcccctactacaatgtccgccagtaccccatcggcatccatcctcagctgacaagggacatctacacagagccggtgctgtacaacaggcctgctggacaaaatctatgccatccatggctcaccgccaacaccaacatcaccttctctgagctggagaatgccttcatcaggccgccgcacctcttcgaccggccggagaacattgtgatctcaaggaagaggcatcaaagccccttcaatgctgagcattattcagatctctggagcggccacaggattcaaagcagatatgtcaatgacagcagcctccatgagtacagctatggagaaaacaccaacctcatcaccaccatcaacccttcaagccgcgccatcaacagggtggacagcagcatcatcaacttgaggaaccccttcgccggcgtcagcggcgtgatgcaagcctccttcctgccaaatggaggaggcttcacctccgtggtgaatcctccaaactcaggctgccgcgacacctatgacaccattgatgatcttcctgtctccaccaaccaggaggacaaccacaccttgagccacatcaccttctatgatttcatgatctctggaaggctggacaggatcttggcgccgatgtatgtttggacaaggcaagatgtggacctcaccaacaccattgctgctgacaggatcactcagatcccgctggtgaaggcttcaagcattgctggcatcaccgtggtgaaggggccaggcttcaccggcggcgacatcatccagatgttcggcgtcaaccctgtttttccttctaatgtctccaccaacatcagggtgcaaagcaaccagagctctcctcaaagatatcatgtgaggatctactatgcttgctcaggaagcagcgacctcatcctccgcctcggcgccaacaacatcaatgcaaggattccttccaccatgtcaccaggagagccgctgacatatcagagcttcaacttcagatccttcaatgatcctgtcaccttggcgccaggaagcaatgagttctccatcttcagaacaagcggcgccgccatcctcttcatcgacaggatcgagttcatccccgtcaacccaacaagagaagcagaagaa

SEQ ID NO: 279 - DNA, 1992 bp, Artificial Sequence
  synthetic sequence encoding toxin protein
atgacaaggaacaggcaagatgaatatgagatcattgatgcaagcaactgtggctgtgcttctgatgatgtcaacagatatcctcttgcttcagatccaaatgctgctcttcaaaacatcaactacaaggagtacctccagatgacagaaggagattacaccgacagcaacatctctccttccttcatctcaggaagagatgttcttcaaactggaattgacattgttggaaggattcttggcttcatcggcgtccccttcgtcggccaaattgttggcttctacaccttcctcctcaaccagctctggccaacaaatgacaatgctgtttgggaggccttcatggctcagattgaggagctgatcaaccaaaggatctcagaagctgttgttggcctcgccgccgacaacctcaccggcctccacaacaactatgatctttatgtagaagctctggaagaatggctggagaggccaaatggagctcgcgcctccttggtgttccaaagattcaatgtgctggatggcctcttcacccagttcatgccatcatttggaactggacctggatcaaggaactatgctgttcctctgctgaatgtctacacccaagctgcaaacctccatctgctgctgctgaaggatgctgagatctatggagaaagatggggcctcaaccaaacacagatcaacagcttccacacaaggcagcagaacttgacaagagattacaccaaccactgcgtcaccacctacaacagcggcctggaccgcctccgcggcacaaatgcaacatcatgggcaaactaccatcagtacagaagagagatgacattgatggtgcttgatcttgtcaccctcttcccctactacaatgttcgccagtaccccattggcatccatcctcagctgacaagagacatctacacagaaccagtgctgtacaacaggcctgctggacaaaatctatgccatccatggctcaccgccaacaccaacatcaccttctctgagctggaaaatgccttcatcaggccgccgcacctcttcgacaggccagaaaacattgtgatctcaaggaagaggcatcaaagccccttcaatgctgaacattattcagatctctggagcggccacaggattcaaagcagatatgtcaatgacagcagcctccatgaatacagctatggagaaaacaccaacctcatcaccaccatcaacccttcaagcagggccatcaacagggtggacagcagcatcatcaacttgaggaaccccttcgccggcgtcagcggcgtgatgcaagcatccttccttccaaatggaggaggcttcacctccgtggtgaatcctccaaactcaggctgccgcgacacctatgacaccattgatgatcttcctgtttccaccaaccaagaggacaaccacaccttgagccacatcaccttctatgatttcatgatctctggaaggctggacaggatcttggcgccaatgtatgtttggacaaggcaagatgttgatctcaccaacaccattgctgctgacaggatcactcagattcctctggtgaaggcttcaagcattgctggcatcaccgtggtgaaaggacctggcttcaccggcggcgacatcatccagatgttcggcgtcaaccctgtttttccttctaatgtttccaccaacatcagggtgcaaagcaaccaaagctctcctcaaagatatcatgtgaggatctactatgcttgctcaggaagcagcgacctcatcctccgcctcggcgccaacaacatcaatgcaaggattccttccaccatgtcaccaggagaacctctgacatatcagagcttcaacttcagatccttcaatgatcctgtcaccttggctcctggaagcaatgagttctccatcttcagaacaagcggcgccgccatcctcttcatcgacaggattgagttcatccctgtcaacccaacaagagaagcagaagaa

SEQ ID NO: 280 - DNA, 3492 bp, Artificial Sequence
  synthetic sequence encoding toxin protein
atgaactgcattggaggaaaatgcatgacaaggaacaggcaagatgaatatgagatcatcgacgccagcaactgcggctgcgcctctgatgatgtcaacagatatcctcttgcttcagatccaaatgctgctctccagaacatcaactacaaggagtacctccagatgacagaaggagactacaccgacagcaacatctctccttccttcatctcaggaagagatgtgctgcaaactggcattgacattgttggaaggatcttgggcttcatcggcgtccccttcgtcggccagattgttggcttctacaccttcctcctcaaccagctctggccaacaaatgacaatgctgtttgggaggccttcatggcgcagatcgaggagctgatcaaccagaggatctcagaagctgtggtgggcctcgccgccgacaacctcaccggcctccacaacaactatgatctctatgtagaagctctggaagaatggctggagaggccaaatggcgcgcgcgcctccttggtgttccagaggttcaatgtgctggatggcctcttcacccagttcatgccctcctttggaactggacctggatcaaggaactatgctgttcctctgctgaatgtctacacccaagctgccaacctccacctgctgctgctgaaggatgctgagatctatggagaaagatggggcctcaaccaaacccagatcaacagcttccacacaaggcagcagaacttgacaagggactacaccaaccactgcgtcaccacctacaacagcggcctggacaggctgagaggaacaaatgcaacatcatgggccaactaccaccagtacaggagggagatgaccttgatggtgcttgatctggtcaccctcttcccctactacaatgtccgccagtaccccatcggcatccatcctcagctgacaagggacatctacactgagccggtgctgtacaacaggcctgctggccagaacctctgccatccatggctcaccgccaacaccaacatcaccttctcagagctggagaatgccttcatcaggccgccgcacctcttcgaccggccggagaacattgtgatctcaaggaagaggcatcaaagccccttcaatgctgagcactacagcgacctctggagcggccacaggattcaaagcagatatgtcaatgacagcagcctccatgagtacagctatggagaaaacaccaacctcatcaccaccatcaacccttcaagccgcgccatcaacagggtggacagcagcatcatcaacttgaggaaccccttcgccggcgtcagcggcgtgatgcaagcctccttcctgccaaatggaggaggcttcacctccgtggtgaatcctccaaacagcggctgccgcgacacctatgacaccattgatgatcttcctgtctccaccaaccaggaggacaaccacaccttgtcacacatcaccttctatgatttcatgatctctggaaggctggacaggatcttggcgccgatgtatgtttggacaaggcaagatgttgatctcaccaacaccattgctgctgacaggatcactcagatcccgctggtgaaggcttcaagcattgctggcatcaccgtggtgaaggggccaggcttcaccggcggcgacatcatccagatgttcggcgtcaaccctgtttttccttcaaatgtttcaactaacatcagggtgcaaagcaaccagagctcgccgcagagatatcatgtgaggatctactatgcttgctctggaagcagcgacctcatcctccgcctcggcgccaacaacatcaatgcaaggattccttccaccatgtcaccaggagagccgctgacatatcagagcttcaacttcagatccttcaatgatcctgtcaccttggcgccaggaagcaatgagttctccatcttcagaacaagcggcgccgccatcctcttcatcgacaggatcgagttcatccccgtcaacccaacaagagaagcagaagaagatctggagaatgccaagaaggctgtttcaagcctcttcacaaggacaagagatggcctcaaggtgaatgtcaccgactaccaggtggatcaagctgccaacctggtgagctgcttgacagatgagcaatatgctcatgacaagaagatgctgctggaggccgtccgcgccgccaagaggcattcaagagaaaggaacctgctgcaagatccagatttcaatgccatcaacagcacagaagaaaatggatggagagcaagcaatggcattgtgatctcagaaggagggccgctctacaaaggaagaagcctctaccttccttctgcaaatgaaggatatccaacatacatctaccagaaggtggatgcttcaaagctcaagccatacacaagatacaggctggatggcttcgtggagagcagccaagatctggagattgatctggtgcaccaccacaaggttcatctggtgaagaatgttcctgacaacctggtgttcgacacatatccagatggaagctgctcaggcatcaacagatgtgaagagcagcagctggtggatgtgcagctggatgctgagaaccatccaatggactgctgtgaagcaagccaaacacatgagttcagcagctacatcaacactggagatctcaatgcttctgttgatcaaggagtttgggtgatcttcaaggtgcaaacaacagatggatatgcaacattaggaaacctggagctggtggaagctgggccgctctctggagagagcttggagcgcgcccaaagagaaaatgcaaaatggaacaccggcctggcaaggaagagagctgaaacagaaagagtttatcaagctgccaagcaatcaatcaaccacctcttcgtggactaccaagatcagcagctgaaccctgatgttggcatggtggagatcacagaagctcaaaacctggtgaacagcatcactgatgtttattcagatgtggtgctccagatccctggcatcaaccaggagatctacacagagctgagcaacaggctccagaaggcctggtatctctacaccagcagaaatgctgttcaaaatggagatttcaacaatgctcttgatggatggcatgcaacaacagatgccaccgtgcagcaaaatggagacatgtacttcctcaacctctcacattgggatgctcaagtgagccagcagttccgcgtccagccaaactgcaaatatgtgctgcgcgtcaccgccgagaaggttggaggaggagatggatatgtcaccatcagagatggagctcatcatcaagaaaccttgaccttcaatgcttgtgattatgacatcaatggcacctacatctcagattccacctacatcaccaaggaggtgggcttctatccagaaacagagcacatgtggattgagatctcagaaacagaaggagccttccacatcgacagcatcgagttcattgaaacacaagaa

SEQ ID NO: 281 - DNA, 3492 bp, Artificial Sequence
  synthetic sequence encoding toxin protein
atgaactgcattggaggaaaatgcatgacaaggaacaggcaagatgaatatgagatcattgatgccagcaactgcggctgtgcttctgatgatgtcaacagatatcctcttgcttcagatccaaatgctgctctccagaacatcaactacaaggagtacctccagatgacagaaggagattacaccgacagcaacatctctccttccttcatctcaggaagagatgtgctgcaaactggcattgacattgttggaaggatcttgggcttcatcggcgtccccttcgtcggccagattgttggcttctacaccttcctcctcaaccagctctggccaacaaatgacaatgctgtttgggaggccttcatggcgcagattgaggagctgatcaaccaaaggatctcagaagctgttgttggcctcgccgccgacaacctcaccggcctccacaacaactatgatctctatgtagaagctctggaagaatggctggagaggccaaatggcgcgcgcgcctccttggtgttccaaaggttcaatgtgctggatggcctcttcacccagttcatgccatcatttggaactggacctggatcaaggaactatgctgttcctctgctgaatgtctacacccaagctgccaacctccatctgctgctgctgaaggatgctgagatctatggagaaagatggggcctcaaccaaacacagatcaacagcttccacacaaggcagcagaacttgacaagggactacaccaaccactgcgtcaccacctacaacagcggcctggacaggctgagaggaacaaatgcaacatcatgggccaactaccaccagtacagaagagagatgaccttgatggtgcttgatctggtcaccctcttcccctactacaatgtccgccagtaccccatcggcatccatcctcagctgacaagggacatctacactgaaccagtgctgtacaacaggcctgctggacaaaacctctgccatccatggctcaccgccaacaccaacatcaccttctcagagctggagaatgccttcatcaggccgccgcacctcttcgacaggccggagaacattgtgatctcaaggaagaggcatcaaagccccttcaatgctgagcactacagcgacctctggagcggccacaggattcaaagcagatatgtcaatgacagcagcctccatgaatacagctatggagaaaacaccaacctcatcaccaccatcaacccttcaagcagggccatcaacagggtggacagcagcatcatcaacttgaggaaccccttcgccggcgtcagcggcgtgatgcaagcctccttccttccaaatggaggaggcttcacctccgtggtgaatcctccaaattctggctgccgcgacacctatgacaccattgatgatcttcctgtctccaccaaccaggaggacaaccacaccttgtcacacatcaccttctatgatttcatgatctctggaaggctggacaggatcttggcgccgatgtatgtttggacaaggcaagatgttgatctcaccaacaccattgctgctgacaggatcactcagattcctctggtgaaggcttcaagcattgctggcatcaccgtggtgaaggggccaggcttcaccggcggcgacatcatccagatgttcggcgtcaaccctgtttttccttcaaatgtttcaactaacatcagggtgcaaagcaaccaaagctcgcctcaaagatatcatgtgaggatctactatgcttgctctggaagcagcgacctcatcctccgcctcggcgccaacaacatcaatgcaaggattccttccaccatgtcaccaggagagccgctgacatatcagagcttcaacttcagatccttcaatgatcctgtcaccttggctcctggaagcaatgagttctccatcttcagaacaagcggcgccgccatcctcttcatcgacaggattgagttcatccctgtcaacccaacaagagaagcagaagaagatctggagaatgccaagaaggctgtttcaagcctcttcacaagaacaagagatggcctcaaggtgaatgtcaccgactaccaggtggatcaagctgccaacctggtgagctgcttgacagatgaacaatatgctcatgacaagaagatgctgctggaggccgtccgcgccgccaagaggcattcaagagaaaggaacctgctgcaagatccagatttcaatgccatcaacagcacagaagaaaatggatggagagcaagcaatggcattgtgatctcagaaggaggacctctctacaaaggaagaagcctctaccttccttctgcaaatgaaggatatccaacatacatctaccagaaggtggatgcttcaaagctcaagccatacacaagatacaggctggatggcttcgtggagagcagccaagatctggagattgatctggtgcaccaccacaaggttcatctggtgaagaatgttcctgacaacctggtgtttgacacatatccagatggaagctgctcaggcatcaacagatgtgaagagcagcagctggtggatgttcagctggatgctgaaaatcatccaatggactgctgtgaagcaagccaaacacatgagttcagcagctacatcaacactggagatctcaatgcttctgttgatcaaggagtttgggtgatcttcaaggtgcaaacaacagatggatatgcaacattaggaaatctggagctggtggaagctgggccgctctctggagagagcttggagcgcgctcaaagagaaaatgcaaaatggaacaccggcctggcaaggaagagagctgaaacagaaagagtttatcaagctgccaagcaatcaatcaaccacctcttcgtggactaccaagatcagcagctgaatccagatgttggcatggtggagatcacagaagctcaaaatctggtgaacagcatcactgatgtttattcagatgtggtgctccagattcctggcatcaaccaggagatctacacagagctgagcaacaggctccagaaggcatggtatctctacacctcaagaaatgctgttcaaaatggagatttcaacaatgctcttgatggatggcatgcaacaacagatgccaccgtgcagcaaaatggagacatgtacttcctcaacctctcacattgggatgctcaagtgagccagcagttccgcgtccagccaaactgcaaatatgttctccgcgtcaccgccgagaaggttggaggaggagatggatatgtcaccatcagagatggagctcatcatcaagaaacattgaccttcaatgcttgtgattatgacatcaatggaacatacatctcagattccacctacatcaccaaggaggtgggcttctatccagaaacagagcacatgtggattgagatctcagaaacagaaggagccttccacatcgacagcatcgagttcattgaaacacaagaa

SEQ ID NO: 282 - DNA, 2037 bp, Artificial Sequence
  synthetic gene encoding toxin protein
atgaacaggaacaaccaaaatgaatgtgagatcatcgacgcgccgcactgcggctgcccttctgatgatgtggtgaagtacccgctggcttcagatccaaatgctgctctccagaacatgaactacaaggactacctccagacatatgatggagactacaccgacagcctcatcaaccccaacctcagcatcaacacaagagatgtgctgcaaactggcatcaccatcgtcggcaggatcttgggcttcctcggcgtgcccttcgccggccagctggtgaccttctacaccttcctcctcaaccagctatggccaacaaatgacaatgctgtttgggaggccttcatggagcagattgaaggcatcattgctcaaaggatctccgagcaagtggtgaggaatgctcttgatgctctcaccggcatccatgactactacgaggagtacctggcggcgctggaggagtggctggagaggccatcaggcgcgcgcgccaacctcgccttccaaagatttgagaacctccaccagctcttcgtgagccagatgccgagcttcggcagcggccctggatcagaaagagatgctgtggcgctgctcaccgtctatgctcaagctgccaacctccatctgctgctgctgaaggatgctgagatctatggagcaagatggggcctccagcaagggcagatcaacctctacttcaatgctcaacaagacaggacaaggatctacaccaaccactgcgtggcaacatacaaccgcggcctcggcgacctccgcggcaccaacactgaatcatggctcaactaccaccagttcagaagggagatgacattgatggccatggacctggtggcgctcttcccctactacaacctccgccaatatcctaatggagcaaatcctcagctgacaagagatgtctacaccgaccccatcgtcttcaacccttcagcaaatgttggcctctgccgccgctggggcaacaatccttacaacaccttctccgagctggagaatgccttcatcaggccgccgcacttcttcgaccgcctcaacagcctcaccatctcaaggaacagatttgatgttggaagcaacttcatcgagccatggagcggccacaccttgaggaggagcttcctcaacacctccgccgtccaagaagacagctatggccagatcaccaaccagaggaccaccatcaacctaccagcaaatggaactggaagagttgagagcaccgccgtggacttccgctcggcgctggtgggcatctacggcgtgaacagggccagcttcatccccggcggcgtcttcaatggaacaactcaaccatcaacaggaggctgccgagatctttatgattcttctgatgagctgccgccggaggagagcagcggcaccttcgagcaccgcctcagccatgtcaccttcttgagcttcaccaccaaccaagctggatcaattgcaaatgctggaagggtgccaacatatgtttggacccaccgtgatgtggacctcaacaacaccatcaccgccgacaggatcacccatctgccgctcatcaagagcaatgttcaaagatcaggccgcgccgtcaaaggacctggcttcaccggcggcgacgtgctgaggatgagcagctctgatgctgacatcagcatcatcggcatcaccgccggcgctccgctgactcagcagtacaggatcaggctgagatatgcttcaaatgttgatgtcaccatcaggctggtgcggcaagacacccagagcaacatcggcagcatcaacctgctgaggacaatgaacagtggagaagaaagcagatatgaaagctacaggacggtggagatgcctggcaacttcagaatgacatcaagctcggcgcagatcaggctcttcacccaaggcctccgcgtcaatggagagctcttcctggacagcttggagttcatccccgtcaacccaacaagagaagcagaagaagatctggaggccgccaagaaggcggtgacaagcctcttcacaaga

SEQ ID NO: 283 - DNA, 2037 bp, Artificial Sequence
  synthetic gene encoding toxin protein
atgaacaggaacaaccaaaatgaatgtgagatcattgatgctcctcattgtggctgcccttctgatgatgtggtgaaatatcctcttgcttcagatccaaatgctgctctccagaacatgaactacaaggactacctccaaacatatgatggagactacaccgacagcttgatcaaccccaacctctccatcaacacaagagatgtgctgcaaactggcatcaccattgttggaaggatcttgggcttcctcggcgtccccttcgccggccagctggtgaccttctacaccttcctcctcaaccagctatggccaacaaatgacaatgctgtttgggaggccttcatggagcagattgaaggcatcattgctcaaaggatctccgagcaagtggtgagaaatgctctggatgctctcaccggcatccatgactactacgaggagtacctcgccgcgctggaagaatggctggagaggccatcaggagcaagggccaacctcgccttccaaagatttgagaacctccaccagctcttcgtgagccagatgccctccttcggcagcggccctggatcagaaagagatgctgtggcgctgctcaccgtctatgctcaagctgccaacctccatctgctgctgctgaaggatgctgagatttatggagctagatggggcctccagcaaggccagatcaacctctacttcaatgctcagcaggacaggacaaggatctacaccaaccactgcgtcgccacctacaacagaggccttggagatctccgcggcaccaacactgaatcatggctgaactaccaccagttcagaagggagatgaccttgatggccatggatctggtggcgctcttcccctactacaacctccgccaatatccaaatggagctaatcctcagctgacaagagatgtctacacagatcccatcgtgttcaacccttctgcaaatgttggcctctgccggagatggggcaacaacccctacaacaccttctcagagctggagaatgccttcatcaggccgccgcacttcttcgaccgcctcaacagcctcaccatcagcaggaacagatttgatgttggaagcaacttcatcgagccatggagcggccacaccttgaggaggagcttcctcaacacctctgctgttcaagaagattcatatggccagatcaccaaccagaggaccaccatcaaccttccagcaaatggaactggaagagttgaaagcaccgccgtggacttcagatctgctctggtgggcatctatggagtgaacagagcttccttcatccccggcggcgtgttcaatggcaccacccagccaagcaccggcggctgccgagatctctatgattcttcagatgagctgccgccagaagaaagcagcggcaccttcgagcaccgcctcagccatgtcaccttcttgagcttcaccaccaaccaagctggaagcattgcaaatgctggaagggtgccaacatatgtttggacccacagagatgttgatctaaacaacaccatcaccgccgacaggatcacccatcttcctctcatcaagagcaatgttcaaagaagtggccgcgccgtcaaggggccaggcttcactggaggagatgtgctgaggatgagctcttcagatgctgacatctccatcatcggcatcaccgccggcgctcctctcacccagcagtacaggatcaggctgcgctatgcaagcaatgttgatgtcaccatcaggctggtgaggcaggacacccaaagcaacattggaagcatcaacctcctccgcaccatgaactcaggagaagaaagcagatatgaaagctacaggacggtggagatgccaggaaacttcagaatgacaagcagctcggcgcagatccgcctcttcacccaaggcctccgcgtcaatggagagctcttcctggacagcttggagttcatccccgtcaacccaacaagagaagcagaagaagatctggaggccgccaagaaggccgtcaccagcctcttcaccagg

That which is claimed:

1. An isolated polypeptide with pesticidal activity, selected from the group consisting of:
    a) a polypeptide comprising the amino acid sequence of SEQ ID NO:96;
    b) a polypeptide comprising an amino acid sequence having at least 95% sequence identity to the amino acid sequence of SEQ ID NO:96, wherein said polypeptide has pesticidal activity; and
    c) a polypeptide that is encoded by the nucleotide sequence of any of SEQ ID NO:36, 206, 207, 282 and 283.

2. The polypeptide of claim 1 further comprising heterologous amino acid sequences.

3. A composition comprising the polypeptide of claim 1.

4. The composition of claim 3, wherein said composition is selected from the group consisting of a powder, dust, pellet, granule, spray, emulsion, colloid, and solution.

5. The composition of claim 3, wherein said composition is prepared by desiccation, lyophilization, homogenization, extraction, filtration, centrifugation, sedimentation, or concentration of a culture of *Bacillus thuringiensis* cells.

6. The composition of claim 3, comprising from about 1% to about 99% by weight of said polypeptide.

7. A method for controlling a lepidopteran or coleopteran pest population comprising contacting said population with a pesticidally-effective amount of the polypeptide of claim 1.

8. A method for killing a lepidopteran or coleopteran pest, comprising contacting said pest with, or feeding to said pest, a pesticidally-effective amount of the polypeptide of claim 1.

9. An isolated or recombinant nucleic acid molecule encoding the protein of claim 1.

10. The isolated or recombinant nucleic acid molecule of claim 9, wherein said nucleotide sequence is a synthetic sequence that has been designed for expression in a plant.

11. The nucleic acid molecule of claim 9, wherein the nucleic acid molecule comprises a nucleotide sequence selected from the group consisting of:
   a) the nucleotide sequence of SEQ ID NO:36;
   b) a nucleotide sequence encoding a polypeptide comprising the amino acid sequence of SEQ ID NO:96; and,
   c) a nucleotide sequence encoding a polypeptide having at least 95% amino acid sequence identity to the amino acid sequence of SEQ ID NO:96, wherein said polypeptide has pesticidal activity.

12. The isolated or recombinant nucleic acid molecule of claim 10, wherein said nucleotide sequence is selected from any of SEQ ID NO:206, 207, 282 and 283.

13. A vector comprising the nucleic acid molecule of claim 9.

14. The vector of claim 13, further comprising a nucleic acid molecule encoding a heterologous polypeptide.

15. A host cell that contains the the recombinant nucleic acid of claim 9.

16. The host cell of claim 15 that is a bacterial host cell.

17. The host cell of claim 15 that is a plant cell.

18. A transgenic plant comprising the host cell of claim 17.

19. The transgenic plant of claim 18, wherein said plant is selected from the group consisting of maize, sorghum, wheat, cabbage, sunflower, tomato, crucifers, peppers, potato, cotton, rice, soybean, sugarbeet, sugarcane, tobacco, barley, and oilseed rape.

20. A method for producing a polypeptide with pesticidal activity, comprising culturing the host cell of claim 15 under conditions in which the nucleic acid molecule encoding the polypeptide is expressed.

21. A plant having stably incorporated into its genome a DNA construct comprising a nucleotide sequence that encodes a protein having pesticidal activity, wherein said nucleotide sequence is selected from the group consisting of:
   a) the nucleotide sequence of any of SEQ ID NO:36, 206, 207, 282 and 283;
   b) a nucleotide sequence encoding a polypeptide comprising the amino acid sequence of any of SEQ ID NO:96; and,
   c) a nucleotide sequence encoding a polypeptide having at least 95% amino acid sequence identity to the amino acid sequence of SEQ ID NO:96, wherein said polypeptide has pesticidal activity;
wherein said nucleotide sequence is operably linked to a promoter that drives expression of a coding sequence in a plant cell.

22. The plant of claim 21, wherein said plant is a plant cell.

23. A transgenic seed comprising the nucleic acid molecule of claim 9.

24. A method for protecting a plant from a pest, comprising introducing into said plant or cell thereof at least one expression vector comprising a nucleotide sequence that encodes a pesticidal polypeptide, wherein said nucleotide sequence is selected from the group consisting of:
   a) the nucleotide sequence of any of SEQ ID NO:36, 206, 207, 282 and 283;
   b) a nucleotide sequence encoding a polypeptide comprising the amino acid sequence of any of SEQ ID NO:96; and,
   c) a nucleotide sequence encoding a polypeptide having at least 95% amino acid sequence identity to the amino acid sequence of SEQ ID NO:96, wherein said polypeptide has pesticidal activity.

25. The method of claim 24, wherein said plant produces a pesticidal polypeptide having pesticidal activity against a lepidopteran or coleopteran pest.

26. The recombinant nucleic acid molecule of claim 9, wherein said nucleotide sequence is operably linked to a promoter capable of directing expression of said nucleotide sequence in a plant cell.

* * * * *